United States Patent 10,113,201 (METHODS AND COMPOSITIONS FOR DIAGNOSIS OF GLIOBLASTOMA OR A SUBTYPE THEREOF) - sequence listing, part 3

SEQ ID NO: 35 - DNA, 1112133 bp, Homo sapiens
atgtaccatcctgcctactgggtcgtcttctcggcgacaactgccctgctcttcatcccaggtaccgtacaggggaagggtgttttctctccctggggtgattgtacgacgtgagagcaggagaggcagtggggagatggagaggcaaggaggaaggggtgaggacagggagtgtgagatgcatgtgagtgaaagaggtaggcttgctgtgtgcacgcacacacacactcactcgctcacacgcgcgcagatgctttcagcacgggatttgctctctgttccgggggatccagtgagctgggttcgagatctgcaccatgctgtgaggcactgctgtttcagtgaaagtcaccaactggcattaaccagctgtggtcctgggggtaggagaagaggggtttgaactcccagccataaatccttcttgctgcctatgttgggacctgcagggtggaaggggcaccctcttatctctctcagtcgtggtggtctctctctgtttctgaatcagtccagatctctgcgcctccctgtctctctctctgtttcttttctctctctctctctctctctctctctccctctccacctctccccactctcctcctccctcccttccttcggaactgctctcccctaccctctccccctggagctccttccctgccccatccctccttctcagctcactcatctgctcctgcatttcttgttgtaacacaggccctctactgcctgccgtcctttctttatccttccaccaaatgggcagattatgcccttgaaattcggaatcctctcagtatctccttcctgttccttacgtcaggaatatgaatttcccttggcagaatttgggatgtccctgctgagggaaggttggaaatttggatttgcctgattctccccagccccttccccaccttgtctaatgatttaaatgtgatcccacctctcacagcagttatttgtttggggaaaacaaatctgcagtgacacaggtaagatgctgcaatcctaccaaaatgagcttagcagaagcgttgcaaaattgaaggcatcttaatagatttgataattgcacaggagtcctttgcaagcagacaactgaatgcctgcaggcatctttcaaacaatgccgaaggggctaggttatgcttgccaaggttttaggcagcagcaaaagtgtcggttttcataccaaaccgtcgcacagtcaggatctctttttttcccccaaattgagataaatgcattgtgttaaacattagcttaaacctaaattttcatacatatatacacagacaggaatgctaagattttaaaaccttacctgcctttttataggtaaaacatacagttttatgtttctatattcagtattacttggtagggttttgtgggaatattttcagtgttgtttttaataatataattccctgagtagtcctaagatgccaaagtgaaatcagaaaaatggaagtttactggggagaaagaagagaggatcaactaaaacaagtaatccagcctgtaatgttttgtaacaccttgtgaagatggcactttttaaagcagggatgggctctgcataaccatgttcccagctgtttgttttaggctgaccaagaagttcagagtgggggttgctgttgttgttattccagattccagcagcatcctagggggtccagcctgggggctgtgctcagcagggaaggcagagccaacggaacactcagtacctgcctgagcctggtagagggagctaggtgggtgcactgggtccgtggcaggagaagacaaactttcctgcgtaggcaagtccccagctggatggcagctccggggggcctcctcatacccgcttcccctcctctcactgtgctggagcaaagatcaggacccccatcccaagggaatcctggctgtatggatgcgccccttatggcagaaatcataacattacactttagaaagcaaggcggggggtgagccccagtctgcagaagctgcattgcagcgcgccctgaaggagccaggagccagggtgagacctccttctaggggtcccgtggcactgcactggtggggagcaggcagaacttgcttgcaggagaagtacccgaaactaaagccggctgagggaaaggaggatgaacctgcacccctgcctgaccgtcctgagcatggtggatgaacgacaatgacaagctatcccccccacccccctgcccccatcttctgggggagagcagggtgtggacatcactgcaacatgccctctttctgaagagtctgttacctgctttgagggctactcttatgctaattgtgtcaggagcccggtaagaacaagaacggggaggagaaaaagttagccttagaaggtgtcggtgaaagaacgcttcgcatcttgaggggttcctgtgggaaacctggctggatccggaagttctgatgagctgccatggcttacttgcgacttctcctttctcttttcttttacttcctgttatagctttagacttttttttctttgtttcaaatgatgatgctttttctcccacagggattaataccagctcgttagccacttactttcactgcgtctaaaaaccaaaggctgatgtaataatggaaccttgacctggttaggcctcaatgccattttattctgcagcttctatttcttggtaaaacatgtatccatcccagagtaattttaaggttaatgctgttgtcgcctggtaccttccactgatatcacaaatagcttttctaggcagaatttctgggatggaaaagacagtcaccacgtggagactgagatgagcccacacccaagacagggcagagggcccgtggccaactgacttgtcatgctagaggcacagtccgaggctctggacacccctggttggggtaattttgttgttctagtaggaggagagagatagtctgggctggtggccttcttgaccttgggtctgggggctctgtaggaagcaggaagcgaatactgctagatatgtgcatcagaatcacctaggaggagagaggcaggttaaaatgtggagtccctgtcctcgtctcagacggaagcattttgaactagcatcccaggtccttctgattacctgcaaaccactctgtctgtcacttaaaacctgtgaccatggcctacagtatttgagtatttgagtatttgagtcaaaacctgtcttcttcttgtcttttctcctccagctttgagaaatggctctgtggccatggggcagggtggagtaagggcaagaagatgttgtcattgccagcagccaaggctcagttcctgaggcacagtgctgcccaagtccttccaggggccagcaccatgatgcaaggattgctaacttggaagacttctttgctcaaattcagaccatgacttcctgtttgtccccttcttcttggcccatcctgtttgtatctccttcgtcttgtgactctaagcaggggagttagctgggaggggtccccatttacccaacctggattgagctgtgtcttcatgcgctgatctgtgagtccaggttctgggtacaacttcatctcttgcaccttaaacaggctttgcccgtttagggtcagaaaaccctgggcttggatagaaaatcccccgaggtttaggattcttccttctctagcacacaccttcctgcttcttccttcagggaagtccccaaatcttgagtttctgggctgggatgtttggctttggggtaaggcctgggggcaggctctacagccaagttttgatgaattcctttcctgctccttagcctctcaccagcccagagccggcgaacctgctaagagtgcctgatgtgcacaaggggtctagtgggggaatccacgcgccagactcactaagaaagagataggaacaaggacagagcatctggtcatgagcaagttcccatcgtcctttagcccatcatggattcacgccatcatgtggccctcaatcccttaaaaatgatcgacatgttaataaggttagactgcgtcatctgcattcagcatgggcccagtggcaatagcaggtgctgagaaggagatagcatcagctgcctcatgaagatggctttttcagtagcctggaactgggcagcactactcaacctgagattaatcagagatcccgacgggcttgaggttctcccatgttccctcggtcctgtctgcctttgtgctttctcgaattcttagcacccttggccacatctctgtaacctagaaaattacagaaggagattctttagacagctggcacttgcctgcatttgttgtctagcagctctgggcctgggtctcccatgccagctactgggaactatctctggtggttacagcctcaaatctgtgtcagggctgcctggggctgagtgcacttccctttaagtgggactccacccaaacctctaagtatgctgaaagctgagagtgatctctttgattagtggctctttgaggcttatttggttggttcaaggcattctctaagtctcagtttaccaatctgtagaatgggttccagccatgtatgaaccttgtttccaactgcacagagtagctgaacacctaggttagatgataacaaataaacacttctaaatttttattataaaaaaactcatcctggtcctctaggaatagggtaaagagagaaggcaactcgcatgttggagaaggggagaggacattccatattgttaaaaatgggagaagataaggtagaatcatactgaccatatatgtatgtctttgtcacagtgatgaaaattagtaaaagacaatctactccttcatttattgaacaagactttatatacgttctgattaaacaatgtattaagatattctcctgcctcaaaaatcattaatcgagtaaaacaggaaattgttaagctttttcttctttttgacccccaataaaatatgcattctgactttgagcttttaggtcttagtttttctgctgtagaaaactaaggcaacagacatggcacctttggtctctcaaaacgttgctttgtggtatatttggtggggtgctagatacatggacttgtatgtcagccttggacagctggaactccaggagccccatctaatagcctttggcctatgggcactggcttttctgatgctggtccgctggacagggaccccatcagcctgcagccctgtttgcagatggactgttgccatctgcctgcagctgcctggggctggagacagagagatatggaagcaaactgtgattcctgtcagtgagctcaagtgtcagcccccagatggtctgtggctgctgacaagccaggctgtcaggagcagtggatgttagcacctctgataccgactggcactttccagacagagagggccaggcaggtggcttcaccttggggcggctctgctctcccactccttctgatcccagtcctcagtgcagggctaggtcctgaggacatttgtccctcttgccttttatgctgttggtgggagacccagacttacaacttgctacttatctgcaaagccttggttgcctctgcattttccctgaggggtggggatggttctaacacagtagggcatggatgtagttccacttgctggatttatacaccactcacttgataccccaagatggtggtatttgtatggctcagggaaggattaaaggtagccctgagaagggagccaaaagaaatccaaaaccagagagaagcttgaagatgaatgtgcttgctactgccttcctctaagcatgtgaacatacattccctcctctcttcttcaccacccccttgccaaccatagatgcatgccccttcctgcacacatatacacgcaaggcacacatgcatttccaagccagagtttagctactctcaaaatcacattcacagctctttaaggaaagcaagtcttccctcttgccttctatatctgcctttccagaactcccaactctagcccccagccttggtgctctccctgtgggcacacatggcaggaggcccacaggctgcctgtgccagacacggccatacatgtgtgagtgcttcttcctagcaacgcagagattccctgcacatccacccactcgcctctgcgccccagagccagtaagtaggtgctagaggcagggcttttgcttgtctcccatcacgtcctgtcgccacccccaccccagacctcttggttcggagaggctggggaccatcctgcagtcactagcctaacttaattaaaagtttacaaaatgctttgagaaccccctgggcaatgtgctgggtaagtgcaaaggattatcattatgatgcaggcgcattctcgttaatgagcggagatgctgtgctgagagacccccggaaaggccaagatgaattgatgcagtgggacacaggccgttgattggaatggctccttgcacttagcatgggaaacgataagtgacaatcagattgcacagtgaactccaacgtggagaaaaccaggctatctggcacttcaaggggcagagtctctcaagtggcctgagcggtcattctggaacctttattcctggggaatttacaaatggtgttttaccacacttgggagttactaacggttttagaaacacagtggtctcattccttatggatcacctggaaaaacttatctttggtctcatttgttcctcactaagagactgtgaggtaggcagtgtagatgtcaccctattgtgatctgatcttcgcgttgcctaaaaccctatgtagacttccggttgactttagaatagacttcgaaacacttcaaatgacccacaaggccatgatctggccctgcattcatctagcttcatctccagctctctgcctttccagctctggactttagtcactctggacaatcacagttccgtagacaaggcctgttccctccttcctcaagggcttcacctgtcaggttacctgagcttggaaaattctgatcctcttataattttttctggctacacatcctttccatccttcagaactcagcttaaatgctgctttcccaggagctcattctttatgcttcaaagtaggcgaggcttccctgtttattgtgcaagtcctcggaaccagacttctcttttctaaaactgtgagtccatgtatttcaaactaattcttggttttatgtctctctttcctccctagaccattgtttatacaggcagagaccacacctgttttgttctccaatatgttctcagtgcctagcacgggtgggagagagcaagtgctcaaacagtatttgttgaacaaatgaatgagagaatgaatgaatgaataaataaacactgagtgctcacttactttaggcaatcattctgttccatcccactgagtcctcaaaggcattgaggcccccagtttggcctgcccagcagcttgtcccctgcagaatgagggcaagaagcttggggatgtgccttgcttctgagagacgggaatgtgcagggaatgcttataatgattactcattccagtgttcttgcttgtcaataaacaccagctctgagctaccgaccaaacacacatgcagcagcacagagctggagcagcacacttttggatctcacatcgcacactgcgacagacacgcctgagagtgtgagtcgttccgtaaacacagatgtgggccctaatgtgggctattggtttaatacaaactaaaattactcagcacgtttaatcagggtgtctgctgaaatggccccagttatttgaaatttagagtcaggcccatggtgctaacaagcaaaaactgtaccaatcaaaaggagaattctgttgttcataggaagtgcaatgttgggttagagatacaaaaatgcaattgcatagcagaaggtcatgaatggtcaatcaatgcttaaacgggttgatgttcatatggaaaaggtaaaaagcagcttagcaaatcacaggatataaaaaagggtgctgtatcacttcttgcacctactcacttatcgcagtctggcctatttcacggtcttgctgttgtatggctgtgggattctgaatggcggacatcctgacttattcatctctgaatactctacagtaccaagcacatttatttattcaacatgtgatttattgagtgattactatgtgacaaatactatgctaggcattgggaatgtatgcctgaacagaaattgttatggttcctgctctcatgaagcttacagtccagagggagagacagacatgcgtcaaacaaacacccagacagttgtgaaatcatgaccgacatgaaactatggaaggggaggtgtgtggtgctgtgattgtctgtcaggagagcttgatcttgccagggaggctggtgaagccttggttatgaaagtgacaattgaacagagatttgaaggaggaggagtagaaattatccacacccaagagcaaagaccaaaggaagaggcagaatgaacaggacgggcaaagtcccatagcatgaagaatcagagcacattctcccacctgactggagtgtagaggaagaaagcatgggccaagatgaggctggcagcctggtaaggggtcagaagatgaagacagcccttgaaggtcatgtgaatcattttggtctttatcctagaaataatggaactctgttgatgtgattcatgatttacattttttattcttgttcttgttgcagttggcagaatagattgggagagaacaaaccaggaagggatagactagtcggaagactactgtagtagttcaggcaggagatggctgtgccttggaacttaggaaatattggttggaatggagacacgaatgcacttgggaacttttaaaggaaagttgtaggtgggagtcagaatctgcagaactgaaatctaagtctccccactgtcagcaccaacactcctgggagagtgctgagaagagcgtccgtcctcaggttcctgcttgtatgctatctctttcagtttaggtgtgatcttgtcctggaacaaggaataggttgtttttagaaatcccatacttcttggcggtctaataatctcaatctcttaactggtgccctctctgggtctaatgtagggcttaaaattgaataactcggtttctctacccttcaaaaatattacaaaaagccctagttgtgttttgtcttctggattctgtctgtggttgtttcctcctggaagaaatcaggcattttagaaaagcgctaattggacgccatagtagcttgtggccaccaagatgcaactagttcacaaatattatcacgatgcaaagcatgtatgacctccacatggcccaccgcctagacccctctgagcagagagtggcatctatggctggctccctacaaacattttttaaattgcagtaatttatttaaaaagtgaaaggtccttggaatcaaaagggaccttggaaattgtctagttgagtgctttcattttatagatgaagcactcgggcaaagggcatctgagtgtcttacctgaagtcacatagtcagatagtgactgagccccctcttgaatacagctcttctcgtcacctgtcgcgtgtcatatcaaatcatagtgaagggctggactgaactttgcctcccaatctgttacgctgctggaaaacggacctataaccttgaccattactgtgttcccttgaagctctctcaccttagtgtacaaagaacattgtggaacaaggtagctccaagctccctcttacccaaagatcagaatctaggtcaaaaacaaacaaacagaagccctgtctccttcagtggcatttgcatacttcgaatgacctttgtaatgatctgggagacttccagaaatactttgctccttgatatgcagaagaatatgttcagggtagtacaataccaaatgccagatacgtgtcaacttgacttgtttggtctacgcaccatgacaggtacctgattttatcatcactacactatcaaaacatctatttttaaatatctgtttgggcttggctctgcactaagccaagagaaaatctatactgagaatcccacagtctctacattaatgattcatgttaaatggtggcttagagtgtacaaatcacatacatgtacggcatgactattttgtgtgctactaagggaaagagccaaatgcactaggtcttcttacctccccactcctaataccaccacactgccttcacagttgacaacatagacatgggtgcaatcaaaacaataggtccaaaagagctgtagacaaatgtagaacaggaagccagagttcagactcaaaaccatgccagatatggtcagatggtagcaggccgaaacaggacagtggggaggccaagcccctatgagaatttccattctaggaagaaaggcctacagaagcctttggcttctccgaataagctaacctggttctcctgaacatcccagtgccaagggatttcccatacccctcaaagagaggaggatgttggaagagagaatgtggcagatggaaatagcccatcagcttacaggctccaagagaagctgcagtttccttgggagtcccctggctttatcccatggaggagagagtgcccagtcttacttggcactgggatggatgcctctttgggtgaagcccagatgggaaggaatcatgaaaaccactatcaggattttgcatgtttttctggtgggccccaccctccttttgtttggtgcgaattcttgagagtcaatggatactaccttataactgccatcagtttagcccacaatgtccatgaagattgggtcacttctttcttatggcccagatgactgtttcttttcttctttcactgaaattacttatttttaaagcaaacaattagctatcctgccttcaccgtgtggaaggaagcactgacttcctgacccaggatgtggcccctgactttgcctctgactttgcctcacagcttatgagccaagtgatcttgggcaagcagtttaatgtattgaatacctgtaattctctctgtaaaatccaaaagaactgttttgcctaattcgcaagtggacccaaaggtcaggagaggagcccgatggacacaccccttccgaagtgctgtgcagttccaggttgccaggtctccttgccttgcttcggaaggcgacccttgtctgggcatttctctctccattttctgtgacttcctctctctctggctaggacggcttgtgatgataactagcagtggagtgcatgccaaagagtctgtgactcttgttttggagcaggaggcctatccagggaactcctgcattcacttcccaggcatgagtcaatgtttggtttgcctcttttttcccatggagaacactgggaagtggcttatctttccccagctgagccctgccagagaacgtggactttgccatttgggttgtgatgagagacctgaaacgggttcagaaagagctccaacacggagcctcaagtgaagctaaaagtgctctctggctccgtgaagaccaggcctggctgataatgcctgcctcttacagttgcagtcactactaaaagtagaacttccgggaatggtgtttggctgcagaatattcttttgtggaaagaggggtcctctttgacactactgaacatgttttagaaaggggcctgactgatttctctacacatgggctgatgaatgcatccctagaggttagattcgtctttgcccaggcccaaggggaaactacaacatcatctcgtgtccccacaaagccttgcacccatgctgggctaagtccagaatgagcaccactgatttagcaccattgtttttctgcttgcgtgggagaaaggggctgcctttctggaatcagtcatatacccatcttgtactctgccctaatccagcaggctcagcttcttgggagcctcagaaaaagacccagcttgagcagggatagtgaggtggcctgtagttctgaaaatggcccttgagaccaggaacctcccacgcacactgcacttgggaagagtccttctgtctgtgttaccaggctgtcttctgggcagcaaaagtccgcaggacttcagcataaactgggtctctggaggacaggggagctctttgtaacttacccacacattgagtctttgtcttgcctggggtggggtggagagctgctctaaccctcctttgggactagaaaattcattcttcattatgtcttaatattcataaaggtctctgagcctcactttgtatgggcagactctcagagacgtaaggtggcaccgtctagctttggttgtgagctgctcagcacccagccccaggtctgtctcacatgcagcagaagctatgttgatgtggtcaaatttcatagaaacagtggatgctactttagaaggcaattagacacagctaagcttggctggttgaagtcaggtttgtctggcaggcacacgtgcctgtagattagaggtgcgggagaagccattgacacttttactcagtcagtattccagaagcaccattgcagcatgtgtgcctgggagggcaagaggtttgtttgttatcaaggtcatattttatgctgtggctgaagagcagaaacacaagagagttcaggaagataggggagatgggagaaatcaaggaagatgcattatagctttttttcccctggtaaaagcatcttataatcttgattctcctttattttcaactgttcatgattattttttagctatattttggtggtgacatctgggaacagagtgactgtgacagatttttcagtaaagtttccctcgtccttctgttgtgtctctcccagatgctgtaggacttgcttcaccatcaacagatctcacatttaggtctatggctggactttatttttcacaaataaattaatgcataaaaatatgttaattatgctttcagaatttcctgaagtctcctcttttgtattgcattgaacatttggtggtaggtggcagagggaagccagaaagccaaggttagaactaggcagaaagttaggaagaaagtgggactaggaatatctggaagccagagacaaggaagggcaaaggtgaagcccagaccacccagcacaaggttctgctgggacagagacggaggcagaagatgagtcagccaccccgcaacgggagctcacagtgcaccagggagaaggaatcctgagccctcaggatgttcctgtgcagggccgaggacctcccgtgttgaagaggaggagagaggctttcagggactgtcacccacagggcaagcacctctgtgggctgctcctggcctgacataccagagggcaagttgcagcaatcagacatggcagaaccctagggggcgggcacagggcatctctgcatggacagtggctgccacagatcttccaacctgccactgttcacagcccagcccccaacacaccaggacctgccactgttcacagcccagcccccaacacaccaggacctgccactgtccacgccacagccccacacacaccagcacctgccactgcccacgccacagccccacacacaccagcacctgccactgcccacgccacagccccacacacaccagcacctgccactgcccacgccacagccccacacacaccagcacctgcacactgcccagccataggcacacacacacttgtgcatgcaaatttatatgcacacactcacacacacttgcatacacacccacacccgcacacacttatacacaaacatccatgcacacacttatacacacaaatacccatacctgcccacacttacacacaaacccatccatgcacatccctatgcacacacacacttatttacacacaccatgcctgcacaccacccacccatatgagcacaaacacacccacacacacacacttatacacgcttccatacacattacacacatacatactttgcttatatccacacaccatgcctgcacaccacccacccatatgagcacaaacacacccccccacacacttatacacgcttccatacacattacacacatacataccttgcctatatccacacacaccacccatacacgtgacacatgcacactcttctccacacacaccacacatacatatgcacaccacactcctctcgtgaacctttttttgcttatgaggggtcttttggaggctgtctctctgtaatatgagaggcagaagtgccatgggactcctcctcggaactggcagtgctagagaaagagactgcttcctgggtgtcagaaatggagaaatttaggaccccagtcatcctccttgcccattctgtgcctggtgctcagcaaggtgcacagccttgactgttcccactctgcacacacagtggtcacgagtaccccctgaaagagcggctgtggttactcattcactcactctggctcagaaaactcctccagttctcacctcccttcttcagaaacaccttgttcttgctgagatgtgtccctccattcagctctgtggcctggcgctgctcactgctgcttggaccctggcaccgatggctttgcccaggagtcagcctggctccaattagttttctgtcccctgagatgatgcctctcagatagcttcccacagctccttgtcctgatgcctgggtttctgtctgtacagtccaaacccccaccgccctagcggtaagtatgggggagttgcccccactccctgactccctgttgccctttatcaaccagaggaattccgcttttattacactagcagtacacgatcactttccactattaaaaaattaagacccgctgtactatcagtgggctcccaaattcttgtttatgagctcctgtggtttttacaaaaaccattttaggcatgcacatgcaatatatatttatgcatgtataaatgatgtatataggttactactacacatgtatagaaatatataatcactacacatattttttcttatatataatgataaaaagagtaagataaaaatagataaaagtaggaattctgatattccttcctttcacatccgtgtatcactcagaggacccttgaggacaagcacctctttggagaccattgcagagagtcgtgccacgtgactgggaatggagtccagacagaaatgtcaaatcattcttggcaagatgcgtctaatggcttggctctgactgcctccctctgggacttcgcgtggggatgtgtccttggccacagctcactctggatgtgggtacaatgccgttgctacggaagaccccatcttgtggcagctgtagtgttcttcaacaatgctacctttgtggtaaaaatgagtaacacatcagtgaatacagacctgcatccagaatattctgttgtttatataaaaaataaaaaagaccactgaagggaaatcaatgcaaacagtctttgcgagaagaaaaggccaaggacagggaccatccatccccgtggctcgtaactctccatctccagggttctccgccttctcccgctctgtcccggctctgcaccggctctgcaccagggaccatctaccctggggacactgaggccttagctttcctggtttaggctggaaagcacccttgcccctgaggagaaattcagctaaggtagagttggaatttttcaaaagaggtattattaaaactcattcatggagatacacagaaaagagcaaaactcggaaaaactgggagtggatgcctctccttagcatagtttttgtcctgaagtgactggagtccagccccagccccggcggcggtggtgtgagtgtgtccccccagatctttggctatgggaagtgtgactgactagaagcctcggatgtggctctccgaagcccctggctgtgacggctccaaggtcgcgttctctcagccactatctggccataacagaacgcagtggagatatcaagtcaggtctgctggtgggagatgcgtctcctctgatggagactgacacgaagcctctccaggtacctcagagccttccccagagctgcactgtgctgtctgcctccacccaccagctgccagccttgctctccctctgcgggggtcgcagtccccaagctctcccagatctcatggctcctgcccagcttctctcccagttgtttctcccgataagcgccctgcacacgtagacctgtccttacttctggttgttggaggatgaggctggcgttgtgttgagcaggcatgggagccagcgccagactccatttatcagtttctggtctgttatttgctcaactgctcactctgcgaagttgaactaggactcactcatggcgctgtgaggactgggaaatctttaagatcagtagaaactttttttttttttttcctcttcttggcagaatccaggagccccagcccttggagaccctgccttgacccttgaggaaattaaacattttttgacatgtttccccaaatttctaacttgagtttcgggcttttctggactggtggtaaaggtacttcctttccctcttgatgcaccccaagcccattacaatccatcttctgtgtatttctcatattcctggttggttatctggggcgtagtcactgtttggctcataaagctggtccacccttcagtactgttcctgttcttgattgttatggttttgtattagcttctcgaacttgatttttctattatccctatggcatggcttttcaaccccggcactcttgacgttttaggcacaatagttctttgttatgtgaatttcctgtgcattgtatgatgtttagcaacatccctggcctccagccaccagatgccagtggcaccttttgagctgtgacagcccaagatgtctctagacacagccaaatgccccctggggagcaaaatcatttctggttgagaaccactgctctgtgattttaaatggtcagtgcagtatcctagcaacccctctagctgaagagagttgccttcctcccagctggtggaagatggccttctcttcttgtattacaggactgcacctctgacctgctctggttcaagtctgtgaggagcttctggttctcagcttatctgttttcctggaaattcagtttatccagaacctgtgaatcaagtcatcaaatttttcttcttttccagatgctctttaatgaatactttttagggatggctaataagatgaacatatttgatagtaacactattgggtataatagtagggttgttctagagtggtatatctggaataaattagatatgagaaggcttgcaccatagctgcattattaatttagctggactgactctctcaatgagcatgtgatttttaccaggcaaatggttccagcaactttcttagggtagacttcaatattttagtctactatcttgagggtacacaggagtgagagtgacagctcagacaaatttcctatagacaaaaacataaagctaaactaaaaggcagtatttaaaatcagtgggttataaataacagtgcagacctacgtacagttatggcaatagagttttgagatcaattaagagtactgagccaatttgaaaagaaaggagtctcctaccataaaaaagtgagaattgtcctaaatatttaaaaaaggactcttgactttagtctttaggttacttctaacctaaaggggtcgttggcaggacattcagagtaccctgtatctccctgcaatgatttaagtaacggcagatgccaagcactccagacgaggaggaagggagcacacatgggaagctgacatggagctggcaaacaggaaataagagtgtttggtttttccctctctcttcagtcccttttgggagagacttaggagctaaagaatcaagcccacattccagaggtcagtgtctccaaagctccaaaactagggagcagccaactcgcctcccttgcacacaatcactgcagaaggcatgtgtgaaggttatgtgaccagtatcccctgtactggttcctcattgcatcaaagcctctcatgatccctactgcaaacactgacaatgctgtagctccaaggtcttgcagatgccaggcgatgtgaaccattgccacagttttggggtgtctttgttttcgtttcgtgaccagccttgaagtgtctctttatcttgcataatttgctctccaattctctgtggcagacttctccacagccctagaggggcttggtgtgtagggactgaccctttgggatactgaatcatgatttttttcctgtattcaactgaccttgctggctcgatttctttgctgctgtgttcctgacaacaacaattttagatgctaaactcttaatctctgtaatgcagctcatgaattaagatcttttcatgaaccattataaatgccaaatttagtttagataaaagctacttccttgcaaagctccataggcaacaactaattctacaaggtcattatgcaacaggtatcagttatgcactcactttctaccaggcactagaggctcaggatggcgagatgtctaagacaaggccactctccttgagtgcttcactcagggagacacaattctgtaaacacgttaacaaaacacaatgtactgcctctgcagtcttttgcataaacaatcctatggaagcgcaaggaaggaagaaactagctctgccaggtttcatgaaggaggcttcccagatgagatgacatttgagttgggtttttaaaggatgagaattgcattaaccacatgcactgatgtttggggattggctgggaaacaggagacagggggtaaagcagtggaagaaaggagtaatccaagccaacctccaaattgcagtgttgagaaaagtggcagtgctctgtgatctaagcagtaacactcttgtcgtgctgaagatttggtttgtgtcatttaaatgtcagaaaaattacgaatggggctggtgaaatctgaacttttaataaccccacacatttctcaatgtccatgttataaatagagtcaaaggtgtgagaaaccattttttttttaaatgtttggggcttctcacattatcagaggcatggtgcatctctcttcatattcttctgttgtgtttactcccagggagaattgctacctctaggtttataaattccagacagcaggtccaataagaagaaattcagctttatgccttgaaaggtttgttttaattgtagagtgtgctcaaatttcaggataaaggcatatttagttgctcattgacttcttgaaaatgggtttacatggtgtgatattgtgatataataagaaatatatattggtctctgccctggttcctgggacaaagctgctaatatccttgtagatagggatcctaggagaatcttctgttctgatatttggtctttggctctggtttctgacatggaactcctaagaccttcctaatttcctgagtgataggctagtctgacagagatcctaaatacctcagaatatcctggaggataggaacacctttttgtcccaatgaggcaactctttggtaggctcctggatggactcatgatgtgatcttgttgccaggggaaccaaacatgtgattggaaggttgggacttccagttgttcccctgagatttgggaataggggagagggactgaaggttgagctaatcaccagtggctaataatgtaatcagtcatgcctatgtaagaaagcttccattaaaaagccaaaggacaggattcagagagcttctggattgttgaagacatggagatgcctggaggatggtgccgaggctgtacctcttccccataccttactccattcattccttccatctggctgttcatctgtagcctttgtaacgtgttttataacaagtgggtaaaatgtaagcaaagtgtttccctgagttttgtgagccgctctagtaaatcaatcaaagactgggtggtaggtgtgggaatctagaacgctaatcaaacacaggtaagtaggtttgggacaaatcctgatttgttgctggttggtcagaaacacagatcacaacctggagctttctaatggcctctgaagtggagtagtcttatggaaccaagctcttaacctgcaggatctgatgctcttggaacacccagctggtgttcatcagaaaattgcttagtgtgcgaggaacccccaaccccacaacatctggtgtcaaaagtgtgttgagtgactctgtgagagtaggaaaaagagattcttttgtccctatcttttcagacatggccattgctctttaactcattcattcaacaaatgaagagtaactacctggcatgggtcaagcactgttctaggactttggggtgcaacagcaaataaaacagactaagagttctgcccttaggaagcttacatactagtggagaaaatcttataatacacaacaaacatagcatgtagataaattttatagtatgttagaacaactgaagaaatatggaaaaaagcaaaaaaaaaaagtacatcaggctatggagaatgggattatggggaagagagtcgcaattacaaacaggccagtctggccagacctcactgaaggaggccacacttgggcagagatgtgaaaggggtaaaggagtttggaaagggcattccaggcagaaggactggctggtgcaagacctcagggcatgagtgaatctgcctggcttattcaagcaacagtcaagaggcaagtgaggctcaagcagagtaagcaagtgggaagagagtagtagatgtgggcagagaggtttttaaaggataagggagcttattggggtacccagttagccacgcggtcctgtgtaagaagttcggcttttattctgagttagatgaggagctcattcagatttttagcagaggagtagcaggactcgctttgtttaaaagaacattctggttgctaaagcttagaggcagagaccagttaggaagatactgccccagtccaagcagatgaaggtagcttggaacagggagattgcagaggaaatgatagtggaagattatggctgtagctgaaggcagggccaccgggatggcagaatcaggtgagagagagtggattcacggaggactccaaattctttgatccgtacaattggaaggataaagttgacaccaatcgcaatggagttctattggtggaacagggctttagggagggatcaggagtttcctttggatgtgttgaacttgaaatggctatggggcatgttgagtaggcagttggatttgtaatgagattggagtgtgtgtgtgtgtgtgtgcgtgtgtgtgtgtgtgtatgtggctggcatatcaatgacatgtaaagctgcaaagctgcatgtgatcaccagaagaggaatgcagaaagggaagagaagagagtccaacatgcagctctggggaacttcaactaaaagaggtgagggagatgattacatggaggcatgacgagttcatccatggtaacgtgtaggtcaggtagtaaatgggtcaaggtaacaaccttgcttggcttgcaggctttatgttggcacaaaggtcttgaccacatgctatcctaaatcactgcaggacacaattaaaggaacaaaggcagtgctattaaagtacagattccatttatatcagtcccttaagtatttagtgctggggcatgaagaaaagcccaagagagggggaagctaattctatgcccacaaacgatttgcatcataaggaaccttaagaccatttaagacaaacagcttgaatcacaaatgagaaggcttggggtgtggaagtaaactgatttaatcaggctcacacagcaacttgtggcagaatcaggtacagaaatgagctctaattacttctgggcagtgcactttcccctataccctcttccatcttgcaggaagtttactctgtagcatacaaaagaaatggtattctgaaaatctgatagcagctcttctcagcctgtgatggcgagacttgaatcaaggggcctcctgggtggtccaggggcagcctgggcactgctcattggctgctcaaacttgtgtgtcaggaagtgcactccctaccagggccagctcagaacaggctgggtgactgtagagacgcacacctgcagtgttaggagtgtcagatggtaagcaagcctgtagcagaactctccacttaaagacttccccacatggcctcactacttttccagtagtcagagcaccaccaaggttagggtaatgtgcctggtgaggggagtggatgtgggcatgaggtaggacccccaaagcctttaagaagagacaccccagaggtggtgcctcacaaaggaagagtaatcaatgagaactcgtggagtaaatggagacttacatagaaagggtactcagtgagtactcatagagtaaatgagtgatccacctaacagaaacagctacctaagcaggttagctagagaggagagaagccaatgccttctaacaacccgtatgacctcgggcagcttggttaacctctctggaacttagtgtttctgcccagaaatgagattggagctcccgacttagaactgtgggagaaggttgattgagagttgtcataggaagtgtgagaggattttcaagacaatctcagagtgagtatggaacagcattgccaccaccgccaagttgcagaagggctgagcttactagcaaagacatggaataaacccaaatgcccatcaatgatagagtggataaagaaaatgtgatacatataccccgtggaatactatgtagccacgaagtggaatgagatcatgtcctttgcaggaatatggaagaagctggaagccattatcctcagcaaactaacactggaacagaaaaccaaacaccacatgttctcacttacaagtggaagctgaataatgagaacatatggacacagggaggcgaacatcacagaatggggcctgtcagtgggacgggggttgagggagagcatcaggataaatagctaatgcatccgggccttaatacctaggtgatggattgataggtgcagcaaaccaccatgatacacgtttaccaatgtaacaaacctgcacgtcctgcacatgtatcccagaacataaaatttaaaaagattgctgtggagattaatacagtgcttcagcactgtgcctgacacataggcactcaataaatggtagtaatttaaatttaaaaaaaaaaacgaacttatatatatcaaaaaaagagaaagggttgagcataagttaggagtggcacgttgggaagcacaggccctgtcgctctgtcccgtcctcttgtctggaaggtgctggggcaagccgagcaagaggtgaggcacagcaagtgttcattcttgactcgagtcgttttcagcgctttccttgctgtttggtgcgcacccagctgcatccggcgtggagggacaaggctgctgacacaggcagatgtgatctgtggtgtaaagtcacggggcagaagacgtttggcagatcctttcacaattacttgcattcttcccactcctccaagtgattgggaggctcgggccagttccttatgaggccagagggagcattgcctgcggcagcccagatgattcctgtgggctggacttgcagtgtggaggcaggtcagccagggccatggctgctgagcttgcagaggtccctcttcaagggcatggggccctcactaaaactgcctaacttgctccatttgggaaactgagggcagaaaccaccctggatcattacatagaaagtgcaaataaaggctcagagaaagaagacattgacatccagtggttcttgtccttagtcttttcactcaaaatgtggttcctagaccagcagtatggaaatgaagaatcctgggctgcacccaggcctataaccttcctctgatttgtacccaaacccagcccaagcacattttcttccaagtagcctttcctggccactgtacacagtaaaaactctttctctgctacctcccagagcaatggctctcaacctgggctgcatatcaggacaacctggggaagcttacaaacaaccacgacactcaggccctgcttccctgaattctgatgtagttgatccgggtaggaaatcagatattaatatttttgaaaagcttccctggtaatcctaatatctagtgttggggaaaacgatcttacagcttgcattattggctctgagtcatttgagatttttttttttttttttgagacatactttcactctgtcacccagtctggagtgcagtggtgtgatctcagctcactgcaacctctgcctcccgggttaaagtgattcttctgcctcagcctcccaagtagctgggattacaggggcccgtcaccacgcctggctaacttttgtaattttgtagtagatatggggtttcaccatgttggccaggctggtattgcactcctgacctcaggtggtccgcccgcctcggcctcccaaagtgctgggattacaagcgtgagccactgtgcccagcctgagattttaaggatttattctctcagtggccacttctacaactgtctttacattgttgtcgccataatcagaaagttaacttgaggacaggaatcatctctagttcccagagtcagtgcttacgacctggtgagaggagccctaggaatcagctcccctcaactctgttcttgcaagcatcactggctgtgtggccactggactttctcagccccaatttcctctctacaaaagaagactgcagtagatgaccccctgaggtgctgcctgcgctgatgtttcatagttcgaatgagcactttgaaaatggggattgattgcagccagcccactgccttggagcctggggctgcacccatttcagcactgtgtcccatcctcctgctccacagagggaggtgctgagctggagttctcccctttgaagctgtgtcttctcagtccagtatcaggctttgctggggccctcttcacgaagacttagcccagtccacagggtctcttggtcctcaggccctcaggctgggctagcgggcagtggataacggtcttctctgttttgatcctcatttatggagcaagggagaaatagacacactttaaaatcagcagtcacaggatgaaaatgggaagtgggggaaagacccacatgcagggataaaaaatatatcagagcagtcagatgcctgttgggtttggaagaaagaaagtggatgagtgggggcactgtgggaaccacagattcaaatggaaaactgtggtctagtgcagaggcaggcagccatcccgaacctgcacagggccagctttgaaggcgtgcaccgagtgcgttctcctgccttctgccccaggacagcacatgggcagtggcgtatgctgattaaacagtaaccattctgtctggggtaccagggtaacacttttctgcttatgtggctaggacaataccatgcactgtttcctgcagccactgcttccactgattttatcagggatgattagagccacctcattgtttcttctgccggccagtgttcccacactgttctcccaggatccttgtctcaggcttatttgaaataataataaaatagtgttgctaatccattcacagatttcctgagggatcacaacgccagagcaggtagaggagcagaggcaaagatggagagaccatctcctgccacatattgtgctggaagcttttggggattagtgagctcatgtcagcaaagccctctgagcccccgcgctcattacccctgagcattttggaggtgctttttatgtgccaagccatttgcaggcactagggaagtaaccctctcagggctctggggagttctttgttctactctttaaaatgcagaaaaagtaattcaagaattttgactgaatgtagggttaaggcctgtggctttcagttcctctttactgtgggacctgggacaagacactttctttccaggggcctccattattttaaacgttgggaaggaatgaaaatacctacctttgtcacactacagaatgtgtgggtccaggtgctactgatggagagggacatttagaaaataggaagaaatatcttgctaatgtaagacattattattctaacattgtgcttccagctgggttggttgatacttattagagaggcttattttgtgcatggtgaaaaccacaatccttaatctcaaggggaagaaaatggtgcgaacttctaaccaataggtcctagtcctcagctcatttggaaaagaaacctatgactgatgaggaaggtcggccgggagtgtggaaacagaacttgcatattcagtcattactcctagcagggaaggcttcatgtggccttcatggaggcagagaggaaggaagcggtgatagttataattcatgtcctctttctaaggaggcaagagaaaaactttgttctcttccttttgggaggcatcagttcacctcattgcttatttatggttaacgattataagacaggggcactggaggccaatgtctatgggtgacaaagagaaactgagtagatggaaaatgtgaggctgagaccaggtttctgggatgaagtctgaggtgtcagtggaagatggtgtgggggagagaaacagtgaagggtcaggaggagtgaagcagagaagaggaagcagattgagggaggaggaagacaggtgcatttggtggtaggaggttcccgagcaggtgctgagcttcagccagactcagccgtcagaacagcctgggttctgtgttccccctgggctttctccccatggagagtctgcctggtagccaggctcaccttttgaagaaaaccaggagctggccctgtgaggtccccttgtccctgcccaggaggcctccggcccccttctctccagtgccagctccaagacagtatccatctcaaaaggccaggtcttaatcccttcccaataagcactgaaactattaacagatacttgaaaaagatggtgttacgttcctattttcctagagagggaattccggggtttgatgaggtcgagggtccttccctaaggtcatgtggtgtgaggcacccggagagcctgcgatcgcctcagtgctgacctctgcatggcccgaaagcctgctgctcagcccctgtgcctgctacattcatcttccctgtccccttagggggtgtctcaacctttcttagtctgtcacatgtaaagtccctgttggccatttttgcttctgtattttaatggtttggactaattcccactttatttttgtatttattttaacacaatcacttataatgaggctaatgacattttgtctccatggtggcgcattttaatttggtcttgaaaatgtcaaagcgatcaggcaatttggtatctcagaaacacaaaacctagcagggacaatggttcctctcttcgtcatttcatctcccttgttatctgctagctcctggggccacccagtcccatttgacggcttctcaatgctggcatggatgaagatcagcagaaaaacatcgccgcaacaaagctgggggctcccgtggctggctctgtccagtaggtgcggttggcacaattaatcagatctcagcactcacaaaagtctgttatggaagcggggcagtcttttactgatggcatttctgtatccatctctgtccttccatcatgccaggggcttcctctgctcctgtctgcagtcttctttctctggctttctaattctttccttgaagacagggtcagcaaatgtattttgtgaagggtcagacagaaactattttagactttgtgaacctcatccagtctctatctcaaattcttcttcttttcaaaactcttaaaaatgcaaaaagtatttcttagcttgcaaaccatatgagatgtcaggcaaccttggatttgggggttctccgtgaaagtgttttaggggatttggattgaggagcttaatctagtttcttttcaggacaggtctgccttgcattacagagccccagatagtgacttccctgaggttaggtggcagatgagttctctgatggtggaggatacagcaagtctccgcagagtgctgattttgatttcctttgagaatgtgggacctggggctagtagagtcttcctcaggaagcccgtcttggcccgtgcttgtctgaatctggagctctcttgtccttgtcttgcctttcctcctcctcccgccttccctgcccacacttctggctgtccatctcctctgcaccctgcttagtcctcgggaggaagaggatggattgactctgcagatggggccaggtctgctttcccagctctgagagcagtcatgtttgtcttttcttcagtgcccaggctttgaagaggctcatctttgagatagaagtcagagtggcgaaagggagggattcttggtgtggtaaaatctttaggtcaaactgggaaagctcccagcctgacccggatagatcccatgtcccaggaattgcctcgtgcaggcttctctttagaaaccactttatcaaacttgttgccagcttttccatgtagtaagaatactttatctctataaagcagcaataagtggacagtatcatatatttcacttttaataaggtgttgccagttgcacacactctgtagagcaattagtgtcaaaagctgctaagcaatggaggagctgcgtttggctgtttacagactagcaggatttacagctgggcttggaggagctgtggccacaacacagagggtgagggaggggttgttgaccagctgagtttaaactccgctgaccctgcatgtttctaaatcttctcaaaggcagcctttgccttgtattatgatgctgggtttgggggctgtaaggtagtgatggttccacagagctcatagggccagggaaacaacatgagtttagggatcccacagatctgagtttcaaacctaactctgctacttaaaggtgacttctaggccagcacatttttctgaaactcactttctttatgcaaaaaggacgtgagaaaaccatcacggagcttagaatatagatcctttttgcattcccagccctcaaatcccctgtgtcctttcaaattgtggcattcctgccccatcaatattaataaggagaagggaagtttagttcaggctaggctgtgcatcttgtactgaacaacttagctgggaactgtcctgattttaaaactgaaagccctgtatcctgagagctctcagtcccaggaaaaccaggatggctggccctcctcagtcccatccagaaggccttcttctgtcataggtgaggggctcaagtgttgccattaccatctcaggaattctggccacacatttaaacataggcaacggcacacatctcctgagaagcagaatagtgggacctgtccccaggctaggaagcaagtggcccagaactgtggtacctgaggacttggactgaaaatcaaaggatctggctacaacattctcagattcctttcttccctgaaaatcgtgatcatttagttgagccttggaagggagaagaaatatttggtttcttttttcctgtacaggtatatgtttagaggctctgcctgtggattcatgccacatcccactcagagcgtccctccacccagctcactccagctctggtcatgacctcagcactgctccagttggggcgagggagcggcccctcctcctttcccagggagcttgtcagccggtttggacgaggacgctggggtgtacgagaacagcatggactgcgtcaccctgcctcggccactggccagccaccctgccaccctgcctctgtctgtcccttttgcagggtgggggcaggagagggggtgggctctaagccgctgctgtatggcgtcatttctcactttgtagagaacacacacctgaggagagcataccagagttcacgtggtgctcctcagtcagctgttgagacagggctcaagtctgggcaccaggtctctcggggcaaagttgtgccagcttcttttctgccacgcttctgccaaaggctgacttgtcctccacagtcagagatgcactttgggcattggaggactgtgggagggtgaaccatggaaggaaaggggggtgagaggaatggctgggtgggggaatgggtaggaggcagcagcggtcgtggaaggggcggctgtggaggagatgctttgaaggagggaaaggcaggaatgagcacagcctcgaggcatgttggtgggcagaaaggctgctggattaggacggaggggagggaggggcagaagtgaggagcccggactggtgaggagggagagctgctcagaggcctggagtgccctgtggaggaggttatgtgactcacgtcgaagatggccagtgcaccctgggcggggtggggggtcttggtcactacctggctcaggtcgtttgaagcccctgcactcccccatgaagccagctcccctcacagtaacctgcaggcagaggggatggactgacttcccccaagtagttccttatcaagccaattggggtgggggaaggtgtagctttatttgatgtatgatcccagagttaaccccatgggactatgtcttctttttctcatataacaaaagagctttcaggaagtcagttatctgatttaaaatattatttcaaatgtttgttgggtacctacttcatttaagttttggaagggatggcagaccaatataaaagggacatgtaattaattggttttgaccatgaaagcataaaccagggctataattaattaattttgccagtgtgattaggtcatgacgtgtgtttggatttcactagccgcactgtaccgtgggggggtccctaggaagtctccaatgaaggggaacgtcatccctggagggagcacacagtttgcgttgcctgtggacagcgtatagaagctggacgggtgaatctggcgcttgtgtgtctccatgttctgtttgcggtgatcccttattacgggcaaggagacaacactgcacagtgtgggtggtgggagcagggggagattggagctccccagcattctctgtcccagcagaatggctagtggtgctggagctgccacaggtttttgttttttcttttctgctaggactgtctcagctccaagcctcctgccccacgcccccatctgccctccccaggagccctgtactgtgcactccccctctgcaagcttcctaattgcaaggagtcatctctcctccctactcagactcctccctctctactttcctgccttctttctcagttcagttaagtcctagtctctgagtttgttctcaaaattcgaaggtttctattttcacacctcagtaattggtgctatccgttgagagtaactctgggaactccagcctgctggggtcaggaagaactgacttgaattaagggagcagaaattggctagatgcaggaggaggactcgagccgggtaattctccccgtgcaggagctgccatgggagctggctagtgggcacctcgccttgtctcctggtcccttaatgggagccctgcaggggaggtggtgggaagggagcgaggcttccctcttggccttactctcagcccagggcatgacactggagactcgagaaatatacgcagtgccaggagaaggcattatgtcagtgaaatgacattggagtatttaaatatgcaaaacaccctctgtttttaatagcataatggcctggagagaagctgacagaagccaggattctcttggtgacaggagttaatccatccactgttcacgccagggtggcagacacagccccactgacctgggtctcagtgaggtaggtccggctcctggttcctgctcacagatgctgtgtgctagtgctgagatgagaggaaatagtgatttttgctatttctcctttgatgtttggaattgaattaatcctttgatttaaaaaagttagccaggtgcggtggctcacgcctgtaaacccagcactttgggaggctgaggtggatggatcatgaggtcaggagttcaagaccagcctggccaagatggtgaaaccccgtctctactaaaaatacaaaaattagctgggtgtggtggcacatgcctgtaatcccagctacttgggaggctgaggcaggagaattgcttgaacccggggggcggaggttgcagtgagccgagatctcaccattgcactccagcctgggcaacagagtgagactccctttcaaaaaaaaaaaaaaatatatatatatatatgtgtatgtatatatatatacatacacatatatatgtgtgtatatatatatacacacacatatatatatgtgtatatatatatatatatttatttttctgctggtggtgttggtcatttgtttttgatctcctggaaggttttccaattattattattttaaaaaaaaccccaacaaacctcttctactcccaggcagcaggtgggtgacccttcttccaggctgtgagatattctctcccaaatccatcagagagtctgcctccagggtagagatgaactacgagtgcagcccacaaagagcctcaaaatctcaaagcatgggcttcccttgggaccaaggaaaggtcagaagagtgagcacggtggcaaaggggttaaggttccatttctcccccacaggaggggaggccagggatcattagcatatacactgatgcatgtatttgtttcccgattggaaatgtaacagatgttaacactatttggatagcaggagaaaatattaaacaaagctaggcaccatttttctttcctattgggaatgcgatggagatgttgtgtaaggaaacttgctttcatgcccactagttcctctgaccctgcctgcccctcgcccgaaatccctggttcccaagactttttccctcactctccactttccatatgggctggtttgctgccaggtcagcaaaaacgttgacttctggagggagctggacggcttttcagcttgtcctcagtggacagggagcattgtgtcaccgtccttcagtgactgcagtggcataaataccatggtggttccaggtcaagatccaacgctggccctgtagcttccaggcttgggatttgtggacttgaacatgtaggagaacctcatgtgcctcattgtagtcatctgtacagtggtaacaatcttaccacatatcacacagggttcttgtaaacataaagccatcattccatcttagagcctgttgggttccataactccatccatggtagctgttattcttacatctaaagtgaccacagatcactcctctggcctgccttgttttataagattcatttctcatgcttaaatcctttttgcagttctcctttgggacctccctggttttcatatccttcctattaagtggagcataaaatcagatgtgcgacgctactggactttggttccaataaggcctgcatctatgtgcctacatttgtcttgcagctgagaccgcacttgttctttgagtaactgttaagctttagccagatgggtggggagaaggacccactatattttcaagtacagttgtcttaggccctgggaggcccagatggtgcgaggaaggctggagagaaggggccctgcgcgatattgtgcccggtttcctgggattgctctagttctgactctcttttctctgactcttctgggtctcgtctgtgtcctttcactgcctcagtctctctgtctcctcttctgtctccctctgtctctggcccttccacatttggctctggcattgtctctacttcatgtcttgacccagcaaaggtagaatttcaggccttccttgccagctttggaagggagtaaagcagaaaacgcagggaagccaggagaggtgctcctgggagagacctgggctcactctggactctgaactggaccccttcagagctcctgtacacactcagaggtgttggaatgaagggaagccttggagcaaccgccgcttgcccggcaccctctcctctcctctccggtggtgcagagatgctgccttggcccccggccctcacacagcctggcctgtaatttatacaagtgcagctgatgttcccttttaaattgacaaaagcagaggatggagcctgggaagccttctgaccctggtgccctggtccgtgaaactgacaggcagtgtgcagtgcactgtctctcgattcacttgcagtggggagatgctggttaatttgccgggactcagaggtgacccaggtttaataaagaggattaatggatttgagctaaaggtcttggctgtttcaagcagatagcctcttccttctaagacagtttgcagccttttgctgagttccttctctttggggaaatagcacaaactgcctatttaaaggggccttccttttcctttcctgcttgacactagctggactgagctggctgtgtgctctgtacgcatactcaaagccagaggcatgagggcccaaaggagaaatgctgttaacaagagcgacgtgaccaaaatctcactttcacactgtgctggtgggagcttccacctgtccagaaagcatcgtagtaacaagaatcaaagctcctaaaatattagaagtcaggagattagttattaagtgaatcgggggggaccagagaaaggaaacgctcaatgaaaggcaatccaaaaaatgaagcaagaagtgaagggagaaatattcaaggaaatagatagcttaaagaaaaaactatcaaaaattcaggaaactttggacacacttttagaaatgcaaaatgctctggaaactctcaacaatagaattgaacaagtagaagaaagaaattcagagcttgaagaaaaggccttcaaattaacccaatccaacaatgacaaagaaaaaagaataagaaaatatgaacaaagactccaagaagtttgggattatgttaaacgaccaaacataagaataattggtgaaaaagcattagacaaaatccagcatccctttatgattaaaactctcagcaaaatcggcatacaagggacacactttaatgtaataaaagccatctatgacagacgcacagccaacataatactgaatggggaaaagttgaaagcattacctctgagaacgggaacaagacagggatgcccacgctcaccactcctcttcaatatagtactggaagtcctagcaagagaaatcagacaagggaaagaaataaaggccatccaaattggtaaagaggaagtcaaactgtccctgtttgctgacaatataatcgtttaccttgaaaaccctaaggactcctccagaaagctcctagaactgataaaagaattcagcaaagtttctggatacaagtttaatgtacacaaatcagtagctcttctatataccaacagtgaccaagtggagaatcaaattaagaactcaaccccttcttacaatagctgcaaaagctataaaatacttaggaatatacctaacaaaagaatcaaaagacttctacaaggaaaactacaaaacaatgctgaaagaaatcatagatgacacaaacaaatggaaacacatcccacgctcatggatgggtagaaccaacattgtgaaaatgaccatactgtcaaaagcaatctacaaatgcaacacatccccatcaaaataccaccatccttcttcacagagttagagaaaacaattctaaaattcatatggaaccaaaaaataacctgcatagccaaagcaagattaagcaagaaggacaaatctggaggcgtcacactacctgatttcaaactgtactattaggccatagtcagcaaaacagtgtggtactggtataaaaataggcacatagaccaatggaacagaatagggaacccagaattaaacccaaatacttatagccaactaatctttgacaaagcaaacaaaaacataaagtgggaaaagacacccttttccacaaatgatgctgggataattggctagccacatgtaggagaatgaaactagatcctcatctctcacattatacaaaagtcaactcaaggtggattaaggacttaagcctaagatgtgaaactataaaaattctagaagataacgttggtaaaacccttccagacattggcttaggcaaggttttcatgaccaagaacccaaaagcaaatgcaataaaaacaatgataaatagctgggacctaattaaacaaaagcgcttttgcagggcaaaaggaacagtcagcagagttaacagacaacccacagagggggagaaaatcttcacaatctatacatcttacaaaggactaatatccagaatctacaacaaagtcaaacaaatcagtaagaaaaaaaaaatcccatcaaaaggtgggttaaggatacgaatagacaattctcaaaagaagatatacaaatggccaacagacatatgaaaaaatgctcaatatcactaatggtcaaagaaatgcaaatcagaaccacaatgcgataccaccttacttttgcaagaatggccataataaaaaaatcaaaaaacggtagatgctggtgtggatgcggtgatcagggaacgcttctccactgctggtgggaaagtaaactaaaacagccactatggaaaacagtgtggagattccttaaagaactaaaagtagaactaccattagatccagcaatcccactactgggtatctacccagaggaaaagaagtcattattcgaataatatacttgcatacgcatgtttatagcagtgcaattcacaattgcaaaatcgtggaaccaacccaaataccaatcaatcaatgagtggataaagaaactgtggtatatatacaatggaatactactcagccataaaaaggaatgaattaatggcatttgcagtgacctgaatgagactggagactattattctaagtgaagtaactcaggaatggaaaaccaaacattgtatgttctcacagatataaaggagctaagctatgaggatgcaaaggcataagaatgatacaatgaacttcggtgacttgggggaaagagtggcagggggcaagggataaaagactacaaatatggtacagcatatactgcttgggtgatgcaccaaactctcacaaatcaccactaaagaagttactcatgtaaccaaataccacctgtaccccaataacttatggaaaaataaaattgaaaaaacttttattttattttattttattattttattattattatactttaagttttagggtacatgtgcacaatgtgcaggttagttacatatgtatacatgtgccatgttggtgtgctgcacccattaactcgtcatttagcattaggtatatctcccaatgctatccctcccccgtccccccgccccacaacagtccccagagtgtgatgttccccttcctgtgtccatgtgttctcattgttcaattcccacctatgagtgagaacatgcagtgtttggctttttgttcttgctatagtttactgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcttgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctgtccagcacctgttgtttcctgactttttaatgatcgccattctaagtggtgtgagatggtatctcattgtggttttgatttgcatttctctgatggccagtgatggtgagcatttttttatgtgtttttttggctgcataaatgtcttcttttgagaatgagaagtgtctgttcatgtcctttgcccactttttgatggggttgtgtgttttttttttttgtaaatttgtttgagttcattgttgattctggatattggccctttgtcagatgagtaggatgtgaaaattttctcccattttgtgggttgcctgttcactctgatggtagtttctttcgctgtgcagaagctctttagtttaattagatcccatatgtcaattttaaagacttaaacgttagacctaaaaccataaaaaccctagaagaaaacctaggcattaccattcaggacataggcatgggcagggacttcatgtctaaaacattaaaaaactcttaaaatattatgcatactctttgacacaacaattttatttttatgattttatcttatgtagtaattaagatgactgcaatgatgtccactaaatgcatgcttattttttttttaaatggagacaaagagatgtataacaatagagaaataggttatactgcctttatgcagtggaataatggttattaagaaaagatgttgtagaagtgtcttattggtttgaaatatattcatgggttataaaatgctatgtttaaactcatttctgtaaaaaaaagtatgcatgtacacatgggggaaggctatgcacccatgtgactgaacgagattcgaggtgactttattttggtgccttgtgtatttatcctcactttctacttatgtctacagttgtatgtcatttgtgtaataatggcagcaagagcccttcatggatctccccaaagggtgctgggtggcccctgaggcctgcccggcgtgcaaggctccaggcttaagcaggctggcttcctgtgctcttaccatcttctctcagaagggtacaggccagaggctcccagccaggatgggggtggccttctggggggcaaggtcatgagctcctcaatcctgcgcttgtcatcactggtcccaggtggtgcattggagagttttgaggggagaggagccctcagtttgagatgcagatactgggctccgaaggactgacaggtggtccttcccaaagggagcagagcctaactgaacccttctccttgcctcgtggtggtgcctgatgcttcttatggcatattctccagtgtgcctttctatcctgttttaaatgactcccacagggatggtgctgctgtatccccaaggagactgcttctgcatctaatagactattctgccatgtaatagacctcgcagttaggacattccctcaagtttccattagccactaagtgcttataaatttcccgttaatatttattcagaaattttactgggcactgaatttaaacttttttttttttttggcagtaattgcctgcttagctcttatctgtctccctgatattaacatcaggattactttttattttcccctttgatcgttgggcatcattgtctccaacttaattcttctgcaaccctgggacgtgttttagtctctaatgacttatctctccattcatatggccatgtcttactttgttattaaaaaaaccccagcaacttctgagcagcctttttacccatgattttagcctcaaatcttcatgacgtttgggttgttcctccctttgcttttatataaggctgttatcaagggtagaaaaagtgtgggtgaaaagctgatttggaatgagagtttcgtctcctaggggattaagtactaaaagaaaaaaaggccaaaagcatccatatgaggccagcattcagtaggaaacacatgtttgtgaaatggatcctctcccagagaagcaggacccagtgcggtggggaggcaggttgattcctagctctgctgtagctctccatggtccccactccccctcttcccttcctgtccactcagtctacacctttggccaggctacgtttttccttagagcaggacagagcactggcgaggtttgcctgctgaaaaagccagcatatgcagtcatgatgagagcttcccatgtgttccttctgtggatgagaccccatgtatgattctaggcactgatttgagcgtgctttcctcatctcctctcctgcctaccccaggctattctaagttttaatcaaggtgtgacacttgctgtgggagcccaggatagaaaggcctcgtgagtgagaatacaagagttctgctatttctgggtcttgcctgattggagttcctgatccttctttcacttttcctgacctcatgttccccctggcatttcggctctgctaactgaatggtaaatgctcagtgcttccctttcttgatgtgctggaagcgactctctctccaaggacctgtggccagaaaaggggttctggtctatagaaagggatcaacgagaagatttcaaacctcatcatgctgctgcagcctgcctcagtcacattctgcctctgggcgattttctgggattcctcgcatagcttatgggtactttttacccatgtttcccctttcccagtgctccctgatgtccttagtggaaatagaaagcaggaattccttagacaaggatctgcagagagggtgggggaaatattgtttatgagcaggagccaaactataaccacacaataagaatgttcccagcccagcctcttctcctctcaagaggaccgttacagtgaaatcgatcaaatgaactgtttttctcccctcacctagtgtgtcgtggtgccttccaaaaatgagtggaaagagacatttttcaaggctgtgtgatgctgaggggaaggtgtaaagtgactaggaggcctcaacataggtgggacgtgagccctggcaagcccagcaagggagtgtctgggctgacttctgcacacccattgattgcctcctcacttctcttcctgcctgaggttgtcgacctgggcatcatccgacactgcacagaccttacccagttcattgacctttgatcaactttcccatagaatttcacactgctgacttctcattcactcactcattcattcgataaatgtttaataaacacctactcactctctgtcaggcagtgttctaggtacaggggatatagcagcaagcaagacacttagcaattctgccttcatgcagcttccattctagtgagaagagattggcagttaaagaataaactctatggtataaggggataagagttatggaacagcataacgttgacgggggcctagggtgaaggaagatgacattttaaagatgtaaaggggatgagatagcaagccatgaggacagccatttgggatgtagcctctctgctgatgtaggattatggctggtatattggaaggaggcctcaatcatcaaaaaaagcaagaaaggaggagagactgccatgggagcttttattcttgttgagttggaaagtcattggaagaccattgtccacagaggagtggcatggtctcacttatatctcctgggctgacccgggcttccatgttgagaggaggtggcttatttggaagcatatttgccttttcttgggattctcactttcattggctttagtagctcactcctgaccctcgttttacttcactgaccttgcctgccatcctgggcctccacatgcttcactgatggctgtatcaatttatgtcttacagaatatgagattcaaaagatgaaaaattaggaatatacaatgttcaagtatatctgcatgtaaaatacaaagaactcacagtgaaatattgaactacaaaaaaagcaggtcatttggagatttttcatctttaatatgtaggtcgggatggaaatctcagaaaggtgggttcctgttgagaattacaaccttatgccactttgtttttattctcaccctcagaacttttctcttgcatgcgtcctgggcacagtggtgtgcaggaaacaacaagctctctgaaggagtaaaacaaaccctgatatgtagcatttgctgattttagggtatatatccttagccatagctgattttaagctcctcatgtatttggtatgaggtacctaaatcttcacttttatttacgataatggtctccagttccatgcatgttgctgcaaaagacatttcatttttttatgactgagtagtattccatggtgtgtgcatgtgtgcatgtaggatgtatatgtatgtataaatatgtatgtgtgtgtatatgtatatgtgtgtgcatgtataaaaaaatatatatatatatatatgtatatacacacacacacacattttcctcatttctctgttgatggacacttagcttgattccataactttgctattgtaaatagtgctgtaataaacatatgagtgtgggtatctttttgaaataatgatttatttccctttgggtagatagccagtagtggggttgatggattgaatggtagttctattttgtattaatttacattccgccaacagtgtataagcattttttagtctctgcatcctcactaacacctgttgttttttgactttttaataatagtcattctgactggtgtaagatagcatcttattgtgttttaatgtacatttctctgattagtgatgttcagcacttttaatatgtttgctggccatttatacgtcttcctttgaaaaatgtctgtttatgtcctttgtccacttttaaatggggttatttgtttttttatttgttgagttgtttgagttccttgtagattctggatttagccctttgtcagatgcatagtttacagtttttttttttaaaccgttctttaggtggtctgttgactttgttgattgtttcttttgctgtgcagaagcttttagtttaattaagtcccatttatctatttttggctttgctgaagttgcttttgggaacttggtcataaattctttgcctaggccaatgtccagaaaagtttttcttaggctttcttctaggatttttatagttccaggtcttacctttaggtctttaatccatcttgagtttttgcatgtggtgagagataggggtccagtttcattcttctgcatatgggtatccaattttcccaacaccatttagtgaagagggtgtcctttccccagtgcacatttttgttgatcctgtcaaaaaccagctggttgcaggtacatggcttttgggggtggggggtgggttctctcttctgtcccattgatctatgtgtgtatttttatgtcagtacaatgcagctttggttaccatagccttgaagtataatttgaagtcatgtagtgtgatgcttccagctttgttcttttgcttgggattgctgtggctattctggtttttattttgtcccatataagatttagcattgttttttataattctgcgaaaaatgacattggtaatttgataaagattgcattgaatctgtagattgctttggtcagtaatgattcttccaatctataagcatggaattttttccatttattagtgtcatctatgatttattccatcataattttgtaggtatctttcaccttcttggttacatatattcctagatattttattttctttagctgttgtaaatggggttgcattcttgatttagcccttggttagatcatcattggtgtatagaaactactgattctgttaattttgtatcctgaaactttatgaaatttgtttatctaatataagagatttttggtggtatctagagttttctagatataagatcatatcatcattgaacaaggataatgtgacttcttcttttccaatttggatgccttttatttttttctcttgcctgattgttctggcaaggacttccagtactatggagaatagaaatgataaaagtgggtatctttgtcttgttccatttcttagagggaatgctttcaacttttctgttaagtaagatgttggctgtgagtttgttgtatatgtcctttattatgttgaggtgtgttccttctatgtctactttgttgaggatgtttatcatgaatggatgctgaattttacccttttctgcatctattgaaatgataatatgatttttatccttttttgtttatgcgatatatcacatttattgatttgtatatgtttaaccatccttgcatccctgggatgaatcccacctgatgatggtgcattatctttttgatgtgctgttggattcagtttgctacagaatgacttcttattgataagttaagcaccaacatcactgagattctgattgggattactttaaatttacacacacgcacacacacacacacacacacacacacaaacacagagtatctctgcaatattgagatttcccaatcagatcacacattcaatcaataaatatctatttaggatctattgctagaaactatccttgcctctgagatagacaagattgccaaagttcctgctgttattagacttaaacattgtgcagagtggtgtggggaggactcatgataagcagatgaataaaagaaaacaaagggaccatttcagataatgtgtgccctatgaagagaaaaacaccaggttgatcaaatagaacataattgagaggaagtctgtttggatggtatattcaggaaatcttctcagagacagttatgttttagctgagacctgatcacaaggagtcagctaaggacaaatttgagagaagagcattttagacagagggaacagccaggacacaagccctaaggtgggaactacactgtctatttcaaaagatcacaaaagaccagtggggagcacgctgcaagatgaagtattttctccctggtcagagacagacaaggattagatcatgtaaagtctcaggggtcatgataaaagatttggatattattctgaatacagtaagaagcctttggagggttttgagtataagagaatgatttgatttgcaatttaccagcttattctagtaccttacaagaatagattatgtgtgtgttgagagaggaaagagaggaggtaggaagttatttagaaaactgttgatgtaatcagaatgaacaatgatgggggctctggaatatggcagtatcagaggagttgagggatgctaatggatttggcatatgttttggaaatagagccagagagtttttgatgcattggttatgtagggggtggaggggaagagggagacagatagagagggaaaggagagatagagagggaaagagagagagagaagagagaagggggggagagagcgagagatagagagagagagagagcaagccagagggaacaagactgcaaagaataaggaatggccgcatactctgtgtgtaccctaaagtaccctccgagtagagacggcaagaggcaagtggaattacaagtcctgagttcaaagtagtgtgtgctagtgtagatatttgagaatcattagtatcttgttatctgttaaagccatcggtttggataagattctcagagaagaggctgctaagagagctctgaggaaatcccacatagatgtcgaggaaaggaagactcagcagaggaggctgtgaaggagcaagcattggaataggaagaaaaacctgatagtgtaattctgaggaagagaaaaaaaaagaagtgtttaaaaagaggtggctactgtgtaggaagttgttggtagtcaaatttgatgagggaagaagacagattcttcagccctttggaactggcaatgcaaaagtaattggtgaccttcaccagagtcattacaaagacatgttgagtttggaaacttgactggagttgaggaaagaatgaaacagaggaaacagaaatacagtcaatttttgtcatttgtggtaatgttctataaaatcaccacaaacattctcttagtgaatatgaaaccattgctcctagagaaaatacagggttaggttcctgcaagcttctggttctttattgggttatgtgtgtttttgcacaaagacttaattcatatatattattgattcatgtacattgaacccaacagcactataactcatgcttaaacaaagatcctctaacacacatattttctctgtaaggcacattatagccttcttgcacttatgaatactatacagcaatttagccctatgcctgtgggccattttaaacagtgaaatcaccaacaaaaagtaaaagaaaaaaaaacagaaaaaacatggcactaagtagactgtgaaacgttggacaagaaagcagagcaccaccttgattaacctcagctgggaatgtgcatgccaggcaactcaaatgtgtttactgctttgcacacatccacaaatgaccagaaatgctctgtaagtattgatttgttgttataaataatttttagcaagtaggtggatttgcatatatggaacccagaataatgcagatggaatgtaccaactctaaggaactctttggagatgttttgctgcaagctctgatgtggtaatgcaggtcttatttcagtttgcttgtaatgttatgggtatttatatgagaggactgatctggtacagaaagaaacttgatgatgcagaaaggaaaattgtttactgagcaaagtctccaataagatgagaagaattggaatctagatcaccagtgaaaagggtagcttttgattacagcagcaagagttagttcatcatgggtgacttccctgttcattcaggacattaaaaaaattcctccataatttttgtagttttatttatataggttttgtgcatttcttattacattaattcctaggtatgtcacacattttgatgttttgaaagggtttcccttataactgtactttataactgcttaatgctggtgtaaaacaaagctattgctttttgtatatttcttttatatccagtcactttattgaatccttagcaagttttcatttttaaatgaagtgtttgtatttttaaaaagataactatgttgtttttcgatgacaatagatgtttctctttttcttctcacagtgtttatttaaaactctaaaatagtactggatattctttttttattcccatgcttaaggaattgctttctgtgcttcaaaatttcatataatatttgctgttggtttttgctatgaagatttatgtgctttaggaaatttccttttttcctatttttctttttactttctttttcgttacatatagttgttaattttaacaactgttaagtatataacagtaataatgttgttgaatgccaagaaagtaatttccctttatattttaatgtaacaacttatcattgataaatctttgatagttgaaagcttctagtgtccatgacatgaactctacttggatatggtacaatttttaatatgctactaaattctattttactattattttacaatatacacattagtaaaattggtctaaatattttccagttagattttgtcacagcatggttgtagccttataaatgaatttgaaaagtttctgcttatttttttcctgtggtttttactatctgttatgtgtcctcagttcttcttgatttcctttcttggctctgttctttggcaacatatccactacctacctgtggatttggctgtcacttctaggtgtgcatctgccaatccctcctttttatctcagttctctgagttaccaattcgtatttccaactgctggctggattttttttgaatttagaaacctagatatagaatattgaatatctcattcatgggacattatcatcattggaccacgcagttaagacctttttcttgttttatttatggagttattctttgatatccccattttccactgccatccccctgtaaagaataattcaaacacatttaatgtgtgctttttaggctcttacatctatctatctatctatctatctatctacctatctatctatctatccatctatcatctatctatcaatcatctatctatcatctatctaatctatctattcatctatgaatctatctatctatctatctatctatctatctatctatctatctatctatctaatctgtccatctatttgtctatctatctatctagctagctagctatctttctatctacctatctatataatctgtctatctatctgtctaatctatctatctttcatctatgaatctatccatcatctattcatctataaatacatctatctataagtctctctatgaatctatctatccatctatcatctatgtatccatcctatctatctatctatctatctatctatctatcatctatgtatctatccatctataaatctctttttctctctatgaatctatgaatctatctaatctgcctattttatctatctatctatctatctatctatctatctatctatctatctatcatctatttatctaatctgtctatctacctaatctattatctatatatctatttatctatctataaatctctttctatctatgaatctatctaatctatcatccattcctttgtctagttatctatctatctaatctatcatctatgtatctatgtatctaatctgtttatcatctatctatccatctataaatctagaagactgtctctctttttctatttatcaatcaatctagctaatctgcctattatctatctatttaatctatcaatcatctatttatctatgttatctatcatatctatctattagctatctatctatctatatctattatctatctatctatctatctatctatctgcctatctatcagctctagtgcgcatttccaactacaatgctatggatgtcctactcttcactttcttcagtatttcctaaattttgccattcttccagatacaaactggtatttcatttttgttttacctcaacatttttctaattactaaataattttctttttatatatttgtaaggcatttgttttttctcctcttaaaatttctcattcaaatattttgcccacatttttattgaggttattgtctttttccttatatgcattctttgtatattctaaatactagccatatcagtttttagacacttcaaatattgttttctagtctattattatctgttaattctatcatgttctctgttgaagtgaatttttaatttcaatgtgatcaaatgtatatattttttgtgtaacattttgggcgtttgtttaagccaacattctctaccccaggtcatgaagatattcttctatttttttttctgttgaattctcagttttaccctcatcattttaatttttaatctatactgtgtctatctttgctgagttaaaatagataacaagctttatttttctccatataataagctagttttcataacatcaattttcttcatcccatttatttatgctgccatctttattgaatcttaaagctctggtagctgatttcagtggtgacagaacaggctcattttgctcaagggtgagatgggacagaggtaacaggagcattcagcagcctcctcccactcacccctcactgccatgccccggccaccctcccttctggttgtggccactgcctaccctccctcccactcaggtgtaaggcagcacccagatcctccaggggcttttcacagacattgttgatatttttgctgttgtaaatttgtaaaacccatgctttcccgtatgaaaccggtgaaccagatatgctaacaaggaacacctcgctagccacccttaactccatgttgtctgctgcctcaaatgcaggacgtctgatttcaaactcccatttcctctcagatgttctcttcccatgtcactgatgacaccgttggcatcattgtcctcccaaatatctgtgactcctctcaccaccattgatctatattgatgagttgtgtggagttgaaaacccagcttcagggttccctgaattttcagttactgtgcttttctgacttccttgcttccacttccaaggctgtgccttagtgacagagctatctgctttactctgattccgattcctctaagtgcccaggtttctgctttatggagactgcaccacttggaatttctttagtacagactccttgtcatgacactcgaagcccattaggtttctgacctcaggtttcctctctcatctcctagaaatcagacctttaggtcggtccattttacttgccatccctggaatagaagggcctcagtgtcccatccctccttcctgtactcctccatcccgttgaatagtcaacaccttacattagttttgtttaaaggttatgaacactgtcctgcacattatttcatttaactttccccctttttttctgtctcatctcaccctgtgtaaatttaaactgtttctcgaggcttaactcagacagacctctgatatagcacctagtgtagtcatagcctatttttcatagtggaataaaacctatcaataaacaatggatttcaccactgatttaagatacatgatcttttgtggacctctgctacaaaataattcccatggatggcctgaatacattttattttctctatctaaaattgtagccacagttacatacatacatttatttatttatttatttatttatttatttatttttttaactggggagaagaattatggtacaatggcagagacttgggctctaatactgtgtctgcccctgggaagctgtgtggccattgatcagtaatttcccttttctgggcttgactcttctctcctgtaaaatgaggtgattagattcttattatttaagggtcttttaagctctaatgttatatttgattgtaaactcttttgggacagaggcagcctcgtgtacttttgtatttataagctgttcaatgaatgtctcaaattgaattagcttcatgatgaaatcctggtcccaaatttgtgttacaacttcacagtcatatatggttaatctcgataaaattatttagcattggtgagctattcatctaagtaatctcttcagttatctttgccacctatgtctacataggcctggccagagcccccaagtgcctgggccccactcagtgtgaacaaaagcctttgcattcttggtgccatggcatgtaattaagtggaaaataattccagcatgacacagaagtgagacttcatacacaaagcaagtaatttaggtccagattattcagtcatcccattcagtattgtatcaactacaggcaaagctctatggtagatgccattgggcttaaaaatacaaatgttgcatgatcctctgtaagcagtttatctccaacttaggaaagtcagatatggatggcactggaatagatgcataataatacaagacagttagctggcacaacaaggtttcaggggaaggagatagtgttttacagaaaaggggtcagaaagagtttcatgcatgataggaggtttaatccagacctggtagagaatggataggattttacagtcagaacaagagcctgagtgatgctgcctgagggcatagttcaagtctcaaagagggagcagatcataaaccagacactgtggctcttaagtcacgtggcgagcaagtggaaggcagaaggccctggacactggtaaggatgggacgagcacacactcactgaactcagaaaaagcagaaggcagtgggatgccgaggtgcagagcaaggccaaagcctggttctaccactccaggttacatgaacaaggacaaggcaggcaaccctccggaccacagtttcctcatctgtcaaataaatacagtgataatagcacctcatgagatgtgagagattcaacagagccagttcagggcaagagatcaccagtgaatggatgagcaagcatgggttagctgtagatgtaggagatcaggactgagaccaagccatccgatcaagggaagggaaggggtggatgtgctgggatgcctgctctaagaaggaaaaagtggggagcccagagcactgtgtgtcttggattggggtccacagaatgagtgtgcagaaattggttaagttaggcactgccccttttagaaacgttcccctttttcttgattttgaggtgacaagcctcccgggctggctccttgggtggtgctcagaaagcaggtggtattagcaaggcaagcttagagatcagtgctcttcgaaggccaggccaggccttagcatcgtgggtggagaggccggtggtggcttttctcaagaatgtgcacaatgggggtggattccaaagatataattaagccatgggtgtcatttgttcggtgggtgtgtgtggtcctctgtggtgtggagctggttcccagcatatgggctcctcgagactgtgcgacttgggtggggcccaaatgggtgaggaccccactcaacagtgtgagcagtggcagggtcaattgtgtgacgcttgacctgagtcactgtaggattcctttggtgtgctgcccttcttgcctccaagctctgcaagaagcccttcagggcctgtgtgcacagcaaagtctgttctgcgagggctcttgactggggctgcatttctgacagtaatgacaacacataggctatggagcttccaggttgccaatttacctgtcttaactcctttaatctgttctggtcatgactcaggctgaggtagggctgagcccaccccaagaatgttccttacatttggtgtggtatgctgatgtgcactgggactctacacagagctgatattgcttgtgatggccatgaatgtgccactgtgcgtgagaatcctctggggaatgcttgtggaaaatgcagacacctgggccttagtttgagtttctgattcaatgggtctgaggtaggctgagatgctgcatctgttacagttcctccaagaggttcagctgcaggcagctcatggaccaactgagaaacacagatttgcagagcgcttgctgtgggccaagaattgtgctaaacgctacataagtcattttacgtatcctttaaagtgcgtcctgttatcatctccattatacagatacaaaaaaagaaaagcaatgaagcaacccaaggcttaggtagattaagtgatttgcccaagagaaaaatgctacaaagtgatggcctgggatgaaattaggatggcgtgacttgtttctttatttaactctggtgcctcaggtgccacagctccagggtgagtagcaggcattcagaattgaaaaaaaaaaatggttacagcatcagttctcaaggaattccaattctaatattaaaggcataagcgaatgttaaatgaggagacatgcaattgaaacctcacaatagtgtttcacatggaaacatgaaacagaaagtatcgttttagtttgtctatagtttaggttggtttcaatggcctttcaaaggaagtagatcctgtacttcaattatttgtcttactccatttgtgttacgtaacttctggaagaaagatggcttgaaagaaaccgatcaatttgcaatatacaatgattctcttaagcagtacaggtggtatatttggggttgggacatggaggatgctgtgagccattccttctccccatgaccccacaaactatgacacgatctacacaacaggagcacagatggtccctgttctctcaaattcaggtccgagacccttggtcaggtcactaaagtctcttactcggagtcaaacctcttcctcgctaaaatggactggggaacttctctgtactggaagaaggaggaggtgctggagggagaggcaggggagaaggactagtctggtaagattgtgatgctgggagaggcaggcaggaggccacaacagaggctgatcctttcatcctcctgccattcccgatgtctcgaagctcaggatgttctccaggggtttggggattctgtactgccaccctgacgcatcttagccaaagcagatttgccccttttccaataaaggcaaaccaaaatgaaatctataattatcattactaattccacttaattagtcgcaagccagcagccaaattggctttctcataattatctgataagcagtaagcacatctcatagattataattaacactacttaattaaaatctaatatacatacaccctttcctcaaaatatatctaatttggttcacaacagcagcagataaaatctcgtctttggttacccctacgtaagtatttcaagttatcactgtcttttcagtctctgaagagaactgagggcaaattgtacatagtttggttattcttcagaaagttataaatgttctccccaggagattgagaaaagtctccagtccttcctctctcttgaaggatcttcccaaactaaggaatgcctggcccgtgatggacatgcggctggtttgtgcttcctgccaaggacatcccaggtcccagcttagatttctttacagttgcgttactgtggacagtgtagaaaaggtcctgtccacctctactctaaaagaaaaaaaacccgcatcaaacttccaccaataatcctagcctaaattttgaaaatgaatgggattcaaagcatttctgaagtcctgaatggctgtgatgtgcattttccacccactgccacctctagtgcactgaggatcgcaggtgtctgatgtattcctgtgggagtgctaactgggattagaagccagggcattcaccgtgttgaaagtgaaaagatctattctttgtgaaattgctagccacccattctgcagagacaagcccagagaacaggttaaaggggaccagagatagttattattttgcatcctctaaaatctatgctaaacagaaggcaaagagcgatggctactcttcgtgtgctgaaggcagaagagggcgaacagaaaaacgtggggggaaaaacaactgtaatggagaaacaaccaaacttttgctaagtgtagacatccccttgatgggcagggggcactgctggcttgtaactgaccttcctgtggcaaacctcagggagggttgtgcgcagttaagctgtgcatttcccaagggtcctgttttgtaaaagtcagccctctgccattgagtcttatccgcctctccccttcacacccagtctagtgcctgaaaatggagggaaaacaatacatggcttctgtattgatgccataatttatgaatggccaacttatttttagacaggttcctgggaggaggttttatactctgatttcagaatgtaaatgatggcaaggagagccagcgggggtgtgaaatgggccaaaactaccggccctccggggtgcttctcactgcttgccctgtcttgccgttctcctcgacactcctggtattaatcatcaccaggacaaagtctgcctttcctgccagatgatctgcttcaggaatgcaagtgttgggattactttgttcattgctgcattgcccactacctccatagggtccaacacatcacaaatgcccaatgtatttctgttgaatgaatacatgaatgaatgtcctgtgacttctttcctactgaaaaaaaggcaaattcactacgaatgattgctacacagggaaaatatttgaaatctgaactgtgcaattgagcccattttcactgatactaaatttctcctatgaagttcattttggatcagaaaaaaaaaaaactaacaacagagtacaaaaagtgtatgtagaatttgtcttggtgtttcttctctctctttactcacttctctctgtgcaccccaatcaggccatttgggtcggtctacagcaactttgacaggctttgggagagtaagtagatgttgtactgtttgtctacttatagttccatcaagggagtagctgtaagtccccagaggatgagcctgtatgttgaaaattaccttaatgggtttttggcccaaacgtgttttccagacatgccttggtctcctgtttactttgccaggtcaattgggtggtgacagctgtgtgaatatagggagagccctgtctgggccatgattttgctggtggtccttagaagcttttgaagccattttgtccttcatcctctttgcactcccagggagatttccaaatggatgcagcttgctactcactagccattgcccctgggaggctccactgccatctcacctaccatccattctcccaccaggcaaggaccttttatttcagtatcttggctgaaagcattttcatcccgtaggaatgatctcaggggagacactcagtttatcctgttctttgactgaagctgcctcagccacctaatccgccatccacgctgggctttctgtaatacgctgggtttaaataaattatattttcaaaggttaagactggatttcagcagtcaactctcctgctgatgtctctcttattttctcaacctaagaaaaagagagagagagctggtaggtttatgaaggaaagagattgttcctgcaatctcagctctgtgaagatgctattaattcttttgcaaaatctcaaatccttccttttcctttgtgttactgcaatgggacagagaggacgctttctgtctggtgcttcttgtttggaaggtccatgagcataggctggatgttgtggggttgtctctttgtctgtaatggataaaaaaacaaaagaagatagaaaatggttggaggaggagaaaggtgaaaagagaggaggagaaatgagtgattgtttctcctgaggtctgcaatgtcaaagaggtgactgtttgttgcatttgcatcctatgtggcttgaaatatttgtattgtcttggacgtgatgctaggtggcaaaacaacaacaacaacaaaaaaacaacaaaaaaaaaccacaaaaacaaaacaaaaaccctacacacaataaaaaataaaaaacaaacatttctgaaacattcagttgtgtaggaatactattatttaaaaactgccgaaatatttccataacagcaacagggtatagaagagcagccagggcctccttgtttcaggcctagggggtaaaggtggcatgtcccacggattgccaaaaactttcttggtaaccgtggtaggtgcctgcactgcttggcaggatgtgcttccttggcaggagcattccctcccatatgtgtgcacgtcactggtacctcctgaggatcctctgtctttgacataatctctgaaggaagcaggcgcttgctgtgtgcactcaaaggccagtgccccagcacatccgagactccccaccctcctctcctatattctctctcaccccgacttcctgccatctgtcttttcatgcaaagaatgaatctgaaagaagtaggttcaggccaagtcttggagggcaaccagagtgagctgggttctgcgggtccatgctcctccagccccgcccttctctccttcaagaatccacctctccaggaatcatggctaccttgccccatacccccagccgcagcagggcttgagatgccttttctgtgcttccacagcaccctatgattttacctgactttaaacttagtacagttcaggaaactcgtctatttcttattcttcttctacatgagactgtaatctcttcaagaataacatgcttacctagaacagtggctggtaaacagctggtgattgataacagcttttgaattcataaatgaatggcattctagttgttcactttagaagtaggtagacctgataaaaatgagaaacatgattgacagctgggatttttacaatgtgtgttacaaagagtccatctactttcctatctgggctctggtcctttatagcagactgtgatatccttggcgtgaagcacgtaccatgcattctagttcagtcagagactggccaattaagagccctcaaggaatattaaattcatgtttacattaagaatataactatgtatgataacaagacttaagctaatttacttattaaatgaaataaataaataacaagtaggaaaaaatagaatgtaaaaagatgatggggtcttctatgtaccaaagaggtatactatttctattcgtagctagtcagtaatagctttgctttaaccctttttagctcagcccattctcaattagaatccattccaatcacaaatatgtctttattaaagtgttactctgtaaaatattatgctcagtatagcatattcttaaaaagctttgtaagtgtgtacaacatttccttcttctttttccggttattagtatgcagatagctcttgggaagccaacccttccaccagccctgcccatgtgggttggatgtactgggcacaaagttagatccagagatggccagtgatccaggcctagccaatggaagcaacaagaaataggcaggggcccagatgtgtcccaagagactgaactctgagacttttgtggaacagttgggaagattatgcatagagatctcaagacggctcccctctctttttgagtctcgtctgattttgttttcctttgttctctgtggggtgcttttttgtagtaacaaaacatggagtaaccttgttcactaaccaacccctatttccttgtctctaagtacttgactcagcaattcaactttttaaaggggttgaaattatttaaaattgcaggcaactttaaagtcagcaaacctatttagccacacaattttaaaataagactgaacaaacattttcacaggaatttcgatgctgcaggagaaagctagcatccttttatcagacacaatgtgttttgttttcaatggaggccatctcctcatcctcaggcctctctatctgggtttatttaaaattcgagactgggttaggtttctgtgctgtttcctgctattaacctttgtcaaccttgttgcctgccttagggggaggtcaaagtcaagttccagaagtagtctaggtaagtaagtgtgatattatagactcatctttcctgaagaatgatttgaagtctcagcctttgtgagctcccagtatgaaacagagagggagagacagtcccagggacagaaaatgcagcatcagtatggttctttgtcccttagtaaaatggtaaaatgttgtcctttgggttagctgtgggccattagtgtgtgggcaggtggggttgggcgctggatcactggagggctgggacaggactggggaagggtggtgcagcagtgcttcctgttccagttattaggatcctgttagtatctccataccccagggacgagattgccaattgctgcagggtctgttcatagatattttcagctaatcttggactttcatttgccagaaacactggaagatttgtcttcacagatgagaaaaaatgaaaggattccttgcagtaggaagacaaaacataattgccacaggctatttctggatccgaggactatttggggctctgctggcagtctcagcattcaaactcagcaagataccctgttgagcccaggtgatgtggccctgagagctcctcgatcccctaaaacagctctcagccaagcagaatggcagccgaagatcggggtttgcctgatctgcatcacatcattatggaagtaagagctattccgttcatgatggaaacctcttccccacctttgcccaggtggcaatgatgctctgaaacgctgctccctaaataccgtcaggactttcttgtgcctgactgggaccatgtaagcagcactgcttcctccaagacacatggcccattgtctcctatttctttgtgatcacgagaagataatgcagagaaatgcatttctattgaaaggccatattgtactactaaagtttcaccaggcaaaggcttggcccggcttctggcatttgcagaggatttgaggattagtggtgaaatgttgtgtgcagaaaagaaaagcaactaaaagagcttcatctctgaaagacagtgtgttaaaagggttcacttgtctttttgacagtagaaaaaaaaaatcaaacttaacttttcattctcacttccattttcctccaaaagtcagccaataggtggggtctgtcaaagcacaaagtgcaatagaaagatcagctctcatggtcagacgtgttagggtcaagcccacttcaggatgactggcagaatcatggcattctgctaggtttccagaaatcctcctgctggtcagggttgcagggaccagggaccatttccacacccttaaactacaagtgtcttttctctactccctctgtcttcaatgactcctgacctcagtttctctttatagcatatccatgttttgaaaataacctattcaattttagaccctgtcatgagcatcatggaaacattttactactcctcaatccttctgttttacctcaagtagtccgtaaaatatgctgtaagtattctattgcttcttccactccggttttttactcttgttttttttaagaaatcatgtttcatattttaaaagatacagaagggaatacagtggaatatctgtgtctttcttccatgcctatgccccagccaaccagttcccctctcccaagatgatcaatgtcattagttctcagtatccttccaaaatcttatatgcatatacaagccaatattctctctagctctctgtctgtctcttcctcttacataaatgatagcatacaatacactcagctctgcatcttgcccttttacctaccaacatttcttggagatcattccatatcagtatataaaggcttcttcactctattttacatattcctttgattgcttctgcatccgttccattcttctgtttctccaaaatcttcctttcaagttctgacttcagtgcaacttctcttaggaagccatccctagtcattccaacctcccagtgatccctcccaatgctgagctgtagactgttgtttgttttctgaactactcatttcctgtattgctagctgtctttaatgtacttgagttgtatctttccatatagactgatgtcttcaaggacagggatcatgtcttatcctgcttcgtagctcctatcacactacgtcatctaacagaagccttttccttagtagggatgcagttagtttgttgatttggtggacagctcagggaacaaaatttgccaactctctgccttttcagagagtctgtgtcagggaccagctttgtttggattgaccctgaatgatctctctagccacaaaaaagccttcttaagcatctctggaaatgcagacaaacatggcttgtcctgagcaaggcacaaaggacagcattcccatccctgtttgctttcaatggttagttgctcttttcactttttcctccaaaagtcagccaatagttggggtctgccaaagcacaaagtgcaatagaaagatcagctcttgtggtcagatgtgttaggatcaagcccacttcaggatgactggcagaatcacagcattctgctgggtttccagaaatcctaccactggtcagggtggcagggaccagggaaagaaaggacatcacactttgccagctttctcacctgccctccttcctcgtgacatttgccagattgtctgggaccagctgtgtgagttgcatctgtcacagggatgggggagctgtgaggcttttccaccctctggtcagcttctctctgggggctttctccaccatgagattgtccctagattaagcaaataatttcagattagtctaattaattctaatagactcattagtgcagtcttagagctcattctcaagggagtgatggtcaaaaactgtgaagagtgttttcttttgtgagaaaatcatgttgttttatttcaagttgggatttcaaacttgacttctgggattaaaaaaataataatctctagtttcgtggagttccattagcttcagtccagatccatagagtcaacatcccctgatgatggtttccccttgaaaatggaggtctttgccattattctgggattgcagggaaggtagaataaatcaggtctcaactttaagcggcttattgcagtgtaatttgggaagactaaatgtaaacaaataaaatgatgactactgtaaggcaatgctgtctaagtgtcagagactgtaaggattttaattgtttagaggtggcagagattattgtgaacttagttggttccagaaaagtttcaaatttgaaagcctctttaagaatgggcagaattttataagagacaaagaaaggtgagaggtatttaaggtacagaagagagcatgtgccaggtaggatctataaaaacctgggggtttttcataaaatagtcggaggagcacttgaggagaacttctgtgttggagatgagggcattgcaggcttagaaagccaattgggtcagacggaggagtctgaaggtcaagtttagagatgaggattcttcctgaaagcaatgagaactcctcaaggccttgttgtgaagagaaaacaattggagcaattgtttaggaaaaacaaacaggtgataacatatggcatgaattgaagtgggctgaggctggagtagggtgaaactggagcaaaaaggaatgagctaagaagcttttgtatgacagcaacatgtcatcatgtgtgaacttcacagaatgcacttatacacacctaggtggtacagcctactacacacctcagctgtacggtggagcctactgctcctagggtacacagctgcacagcatgtcactgtgctgacactgtaggcaactggaacacagtactaaggatttgtgtctccacacatagaaaaggttcagtaaaaaataccatattataatattatgagaccactatcatatatgtggtccatcattggccgaactatcattatgtggaacataaatttagctatttcatgtcatttgttagaaagggagtataaagatacaagtatttctgagagaagtaacacttatctagtcattcataccttagagtgaatgagcagatctgattctctattgggagagaatgtgcagcctaagccaaccccagctcctcagggcagggtaggccccccagtctctggggcagcagccacagccttcagttcccgggtgactatcctaccatttttccctgtgggatggtgcttatacttcacaatgaatattcctgattatcaataattgtttttttccataatattctctaccctcacctgcagggcagagctgctgaacatattatactgcttacctatcctcttcacctcaacccaaatggagaggctgtagatgatttcacaaggtagagaaaggggctgggggagaaatgaacagagtgtttgtgaagtgagctcttgaacgcttgtcaaaaagcctttttctctcagctatcccaaagcaacctattgtcccttggggccaaggtgcccgcaagggctctcagtcaaacacaatttgtattctaatcccatttgcttaggacattttccccagggcttcactgtcacttttaaatctggttctgagagctcatcagagtcagtcatctggacctgacacccttcctgcagccaatgctacccttggctaaatcctagaggacttgggaggctctgcttgtgcctcctggctgccgcagcagtcacagtctccctgggccattccaggaaggtctgagtgtgttgggaaccagaaagagttgcagttatgactttgacagtctcacagcatctgtctccgctgcctgtcccagcatcctttcttcacctataggaaaagagccacgtttgagcacctgcctttgcaggtaggggtctgagagccactggcaagcacagtgctgtgctttgaccctgccatgggaccctggagaggtggcagcaagcatcctggaaaccgtgccattgccatcaatgaaaggcaaggaaaaaccccttaaattctgtcacttgttttaaaacttctacttcatttcaaaccacaacactaaaatttgcagccagcccttatcacctaaggtgtcttattttgagagcattgccaggtactaggagtcttacatgatgtgttgtttgccatccctactgtagaggtgacaaaattgccaaggtcccagaggtagtaagtggccaaggaggagaagactcagatctcctattatacaaatgatctattgtgatataaacaaagctgccattctttcccctccaccacactgctttccaaggtcccaacagcagaatgagtgttgtctttttttcaatttggagtgtgagggaattcattgagcaattggccaaagaagttgggcaccctgaattggtagtgtcacagaagaaggccggggagtcagatactgtggcttattcaccagttctgccattcaggacatatgggaccaggcttatatctcagtttggtgaagtgagaatggtaccacttgatgagccatctgaagaacctgccatggagtgagggaggtactcaataattcttacttccctctctggccatccttctttattttggggagattctcttccagtctttaaaaatattattaatacagtgtttgggccattgtagacatgcaatacctaactgccaaaatgataaataactataagtatacaaacacatgcaatttattttcatttgacttgcttgaggacttttttgagattttagtgacatgctcagaggactgagaatgcagacagaggtgggaggtgatctgtaaaaccaagtagggacagctctaagggtgcctaggaaccccatgacaacttccatccatatcgaatcctgttgtattttgcacttgaaagagaagagcagggatgaaaactatcagctctctaaggacagaggactcctgtgcattttgcccagcattgggcctggcagtgcgcttgtaggaagccaccatcttaggggggcactgggaatgccccttgaatgtccccagtgttctcaaacttcatcaggagagcagtgggttaattcatggttcacagatgttcaactgcataacagatgcaaaaagcaacagctttcttaaatgaacttttttggggaagaaaaaataacagtagttaacttttttggaacaccaaactaaatataaatatctgtttaaaaaaacaaaacaactctacccgaggatatgccagaagtctttaaagcagtaggtttccattttcttccattggctacatgagatgagacattcctttgggagccttgataccgcctgtcttgtctgttagacattagctagggacactgccttcttctttcttcctcttcactcccaccttcttgtcactcaagttactaaatccgaagtattagtatattatcattgaaatttatctaaatttacattaatatgaagaaatgtattttttgtacattttctaaactgagaaaaaagatgtggctggtatttgactacacaggagagtttaaaactttttagcttggtagcgaatgttcgcatagtttaatcccaaattgtcttgttgggtttatttgctacccttctgtagaatggccttttgcttcagcaaaactggtttcctggcctcctgaacctgtgcttccactggccatctccttaagaattctacccatttgctaaggtcacggttccggttctacttcttccagaagagatcaccataacaacaatgagtttgccttcctccaatccaaattgcttgttctctgtacccattacttagccactgatccagagtaatcttttgattttcattttgttcttggattatactgttaagtgttcaagtgtttgtcttatcttctagcagacttctctctggaaatctttgtctcatgctccttcccagcagtgcacaaaacttaaaattttccacatcaaaaagtgtacattacatacttcttgatcctctatagaggcgccattgttgataggtgaagagggaggggcaggattgccatgtggtttctctgagatgtagtgatccatacagccaaatatataatgttatgattcagacactccaagtttgaagccaaacctggtgatttatttcaacagacattttattttgtaaggcattgtagctaaacaaatgcataaaacatatttttaatctttaatctttagaaacatttatgcttgaactcaggatatagatgtatgcattcataaccaaaatgtaagacaaaaagtgactatgacaatatgataactgccatttgttggctacatattttgcatggattgcctccttagtcctcccagtgtccctttacggtggacgatccccatttcatagttgaggtaactttgagaggatacattgtctgcccaagttcagctaacgagtggaggaactgggagttgagcttctgtctgattccagagcccaaatttaactaccaaatataccccttcttggctattccaccacgaaacctatgatattataaaatatatgtgcttattgacttaggacaatgtgaactccacaaaggcaggaggtgtattgtcataaccccagattctagcacagtgcttagcacgcagctgatgctcagatactcggaaagttggacaaatgaactaaaactcatctacacacatagtgatagacagaataatgcccattccaccaccccaaaatgtcctaatccctgggacctgtgaactgtcttacatgacaaaaggaacattgctaatgtaagtcagttaaaaatcttgagatagggagattactctagatcgcttgggtatgcacaaggtaaggaggagggttatggggtcagagtcaccaggaggacctgtgaacagaagcagagtttgcagtgatgtgaagaaggggccagaggtctaagaatgcaggcagtgtctggaagtcagaagaggcaagaaaacagattctctcttgaagccttcagaaggaattaagttctgctgacactttgattgtaaactcctgttctcctgaaccataaaagaaaacatctgtcttgtttgaaaccaccaggtttgtggggattggcacagcaaccacaggtaatgaacagacataccatgctcactctagtgtcccagcctttactgtgtctagcccctcacgctcatgtcactgtcaaactgcagccactgctcagagctgcggtacccgagtctaagggccttgagatcaaggcctgccttaccctctacctcatttccatcattcaatcaaatgacaggtcctgaatatctctcagacccagcagcctccgctcttgtacaaccatcttaggttacgtcactgttacctctcacttaggtttctgaaagcgtgctaacagatctccccctcctctgtgttcctggtaacttttctctatttgtgtccacctcagccacacagccctcatctcagtttctcacacacctcatgcttactctttcttgccgtgggcctttcttctcacaggatgccactctggatgttaataccttgatgtgttcctcctccatttccaaagattctgatccttcctcatatttcaggtttcagctgaagggcagcattccagaaagccttccacatccaatgagggtctcctgccacatggccccagagcgccccacatttctcttctcaaacccatcatattttcttataattcactatttcttgcctattttttcttgtttgactgaaagctctattttgcttgccattgtatcctagggacaaaaacattgcttgatgtgaaaagaaagaatgaataaatgaataagcgagtggatgtggactgacttgaagacaatgattacaaaatggcaagggctttgggtggttgcatttgaatactttaaatgttggagttttgctttatgaataatagagaacattttcaggtgttaaagaatgtggaggacataattaagttgatgactgaggaaaatgaagtgacagcttgtgtgcaggtgtgcaggatggattggagttggagtccctcttatctgttgggatctatattcccaacagataaatatggaactctgcaccaagatgttgaaagcataaatgggaccagtggatagatatgagctctgggaaaaaaagaattaatagaacacaaagatatgttgaatgtggagatgccgatgaagatgtggcccgggtcaattgccaaccatcaccccgctttgttgaagatctatttcaatgttttgagtcctcttgaatcttttcatgtaatttgcataattttaagagtcagcattgtatttgatcatttaattttttaaaactttttttggagaaccaaggtctaaactacttcttggcccaattactccatcagctaaattcgaagtacccagttgggcgcattccaggtgtcggtatagctgaattgaatgaagatgtttattgagagagctagaacagcatagacacggtcttcccctcgagagatagcatctataaggctttattttaaaatttagttaattaaaaggtatttttatattaatatttggtgttgtgaggtggagctcttacactgttggtaagagtataaataggatatcctttcaggagggcactgtgtatcaaaagcccttaaaataatgttgttattgtctttttaaaataaccatttttaattgtggtaaagtgtaaataacaaaatttaccattgtaagcattttcaagtgtacacttcagtggcatcaagtacaaatcatggtgcaaccatcacaataatccatctccaaaacttttattatcttcccaaactgaaactctgtacccattaaacagtcatttcccgattccctctctgacctttccctggtgactatcattccactttttacctcttcatttattttctttctatttttttttttgtttttttaactgtatattcaaaacttaggtttttttgatttttttttttttttttttgagcctgatgtcatgaactcatacagtgcttgccttttgtggctggcttattttgcttagacagcgccttaacgttttatccaggctgtggcttgtgtcataattttcttccttttgaaggatggacaatatctcattgtgtgtacatatcacattttgtttatccacttattcatcagcggacacctgagttgcttccaccttttggctattgtaatgaaggctattataaacatggccacataaatatctgttcattttcttgctcttagttctttcagatatatacacagaagtgaaattcctggaccacatgtcaattttatgcttaattttttgaggaatcaccatagtgttttccacagtggatgcaccattgtacatttttaccagcaatgctacgaggatttcaatttttctacattctccccactacttgttattctctggtattttaataatatccatattaaagggcatgaagagatatcctattgtggttttgatttgcatttctccaatagttagcatgttgagcatcttttcacatgcttattgccattcgtacatctttggaaaaatatctattaaagtcctttgcacatttttaaattgggtttttggtttttattgtagagatgtagtagttctttctatattctgaatattatccattatcagatatataatatgcaatttagtttttactccataggttgcagtttcactctgatgatactggtctttgatgcataaatgtttttaattctgatgaagtccaatttatctactgtttttgttgtctgtgtttttggtttcatatcgaaaaaattattgccaaatccaatgtcatgaaaatttgtcttcatgttttcctctaagatttttatagttttagcttttacacttacatctttggtccatactgagttgattaccttttaataatttataatttattttattttttgcagccattactgaatctgggagagttcatttttgtatatgggctaaattaagggttgaatttcatattttgcatatgaatatctagttttctcaaactttttattgaaaagactatattttcttcattaaatggtcatgacactcttgtttaaaattatttgacaatatattttatggtttgtttcttggctctttgttctactccgttggtttaaacgtctgtcattatgcctattccacagtttaggctaccaaagctttatagtaagttttgatatcaggaaatgtgagacctacacctttgtttttctttatcattattatattgactattggggtttcttgagttttcatatgacttttagaataaatttttcgattcttacaaaaatatcactgggttatggtagagattgtactgaatctttagactgctctgggtagtgttgacaagtttaaagctttcaatccatgaacatgggttgtctttccatttatttctattttcttaaaatttttcaggaagattttgtagttttcactgtataagttttttgcttccttggttttactaattttactcttggttttactgattttctccattgtctttaatagttaagtttattcttaagtattttatgtttttgatgctattgcaagtggaattgttctttaatttcctttttgaattgttcactattagtatatagaacagcaaccaccaatttttgcatgttgattttgtatgttgcgactttgctgaattgatttattaattctaacagtgttttgtgtgtgggtgcatatgtgtgacatttagagttttttacctataagatggtgtcatcgacaaccaaagataattttacttcttccattagaatttcggtgacttatttctttttcttctctaattgctctggcttgtacttctagtactattttgaacacaagtggtgaaagtaggaatccttgtcttgttattgagcctaaaaaaagaagttcagtttttcaccattacgtataattttagctgtgggtttctcatagatggctcttactgagttagatttttttctagtttgttgagtgttttcatcatgaaataatgctaaattttgtcaaatgctttttctgactcaaatgaaatgatcatgtgtttttttccctccttcattccatgaattgtgatttattagattgactgactttcttctcaatgtataaaaccacctttgcatttaaggaataaatctcattttgtcacagtgtataacccttttaatatgctgttgaatcctatttgctagtattttctagagaattaggaagcattccttcctcttcaattttttggaacggtttaaggtgttaattcgttaagtgtttgatgtaattcaccagtgaaaacatctgttcctagttttttatttgtcgtgagttttttgattaccaattcaatctccttattagttataggtctattcaaattttttatttcttcgtgattcagtcctggtaaggtgtgtgtttctaggaatttgttcatttcatttggtaatccaatttcttagtgtacaatcgtttatagtactccttataatcttttctatttctgtcaaattgacaataatattccatgctgatttttttgtcttcttgctcctttttagtcaacctagctaaaagtttgtcaatgttgctaatgttttttaaaaaccaactctttattttactgattttctctattgtctttttaaaaatttgtatttgtctttaatctttattaattcattccttctgctagttttggacttactcttttttccttagtttccaaaaatataaagttaggctattgatttgagaccttttgtcttaataaatgtgagcttttacagccataaattttcctcttagctctgcttttcctacatctcataagttttggtatgacaggtatgtcatgatttatttttgtttttctcaagatattttataattttccttgtgatttcttttttggttgtttaaaggtatgttgatgaacttcaatatatttgtgtgttttccagttttccttctgttgttaatttctcgtcattccattgtgataagaacagacaatttgtattatgtcaattcttttacaatgtattaagactttttctgttgcctaatgcatgagttatcatgaagagtgcaccaagtgcactggagaaaatgtatattctgttgttgctgggtgaagtgttaagtatatgtgtgtcaggtccagttggttataatgttgctcaatttctctgtattcgtatttgatcttctgtctggttgttctatccattactgaaagtgaagtattaaagtttcctactattttagagttatctatttctccttccaattctttcatgtttacatcttatagttgggagctctgatgtttgatgcatatatgcttatagttgttggcaaattaacccttttatcattatataataatcattctttgtctcttgtaacagtttttgacttaaagattactttgtctaatattagttggccgtttttgctctggtcacttttgttttggttactatttgcatagaataccttttcccatattttcactttcaacttatagatgatattaaatctaatgtgagtctcttatatataggatatgcttggattctttctttcaatccattctgtcaatccatgtcttttgattggagagtttaagccacttacataaagtaactactaataaggacactttttgacattttgttgttttttgctgtatgtcttagagccttttgtgtccctcattttttgcatgactgttttccattttgtttacttgattttttatagtaacatattttgaatttcttctcatttccttttgtgtatattctataaatattttctttgtggttactatggggattatatataacattctaaagttatgacaatctttgttaaattgatgccaatgtaactttagtcacatacaaaaactctgcttctttacagctcctcctccccaaacactttatgttgccaaggtcacaaattacatctttatacattatgttcccattaacatagacttataattctttttgcttttggcttttacctagtacataacaattaaaagtggagttacaggccaaaatttctgttaatgtatttatgtttactggagaactttatatatatatatgtgtatatatatacacacacatgtgtgtgtatgtgtgtgtatatatacacacacacgtgcatctatgtgtatatacacacacacgtgcatctatgtgtatatacacacacacgtgcatctatgtgtatatacacacacgtgcatctatgtgtatatatacacacacgtgcatctatgtgtatatatacacacacgtgcatctatgtgtatatatacacacacacgtgcatctatgtgtatatatacacacacacgtgcatctatgtgtatatacacacacacgtgtatatatgtgtatacacacacacacgtgtatatatgtgtacacacacgtgtatatatgtgtatacacacacacgtgtatatatgtgtatacacacacagtgtatatatgtgtatatacacacacacgtgtatatatgtgtatatacacacacgtgtatatatgtgtatatatatacacacacgtgtatatatgtgtatatatatacacacacgtgtatatatgtgtatatatatacacacacgtgtatatatgtgtatatatatacacacacgtgtatatatgtgtatatatatacacacacgtgtatatatgtgtatatatatacacacacgtgtatatatgtgtgtatatatacacacacgtgtatatatatgtgtatatatacacacacgtgtatatatgtgtatatatacacacacgtgtatatatgtgtatatatacacatatatgtatatgtatatatatattttttctcaagatggagtcttgctctgttgcccaggctggagtgcaatggtacgatcttggctcactgcaacctctgcctcctgggttcaagcgattctactgcctcagcttcccaagtagctcggattgcaggtgcatgtcaccatgcccagctaattttttgtacttttagtagagacagggtttcaccatgttggccaggctggtctcgaactcctgacctcatgacccacctgcctaggcctcccaaagtgttgggattataggcgtgagccaccagacctggctaagaactttgtattttgacagagttttgagtgttgtttctttcaacttaaaggatactcgttagcatttcttctggaacaagtctattggtaatgaactacgtccgctcttagttatctgtgaatgtcataatttgtttcccatttttgaataacagttttgctatgtagagaattataatacagagtgagaccatataaaattatacatatatgaaatacagagtgagaccatatatatatatggtgtcttaaagcatatatatgctttaagacaaatataacattaaaaaacataaaaacataaaaaaataaaaagaggccatagatatatggtctcattctgttgcccatactggaatgtagtggcatgatgactgctcactgcagccttgacctcccaggctcaagtgatcctccctcctcagcctcccaagtagttgggactacaggcgtgcaccaccatgcccagttgatttttaaattttttattttttgcagagatggagtctcactatgctgcccaggctagtcttgaactcctgggcttatgtgatcttctgccttgggctcccaaagtgctagaattacggtgataagccactgtacccaacctagattcttgactgatgctttaagaaaacgtttagcatcttaaatatatcatctaattttctctggcctgtaagtttttttgctgagaaatccacttatagtctgtcctggatcacttgtacatgacacgtcactttccttttgctctgttcaagattctctttgtctgtgtcaacaggttgataataatgtgtcttggggttggtctctttgggttggttaatcctacttagacttcttgtatttgcgtgtccgtatttatcttcacatttgtgaagcttttgtccattatttcttcaaataacctcactgcccttttctctctttcctcctcctgggactctgatagtatatattttgtccacttgatgcagcaagagttaattttttaatagtttttccttttgctcttcagagttgatgatttcaaatcacctgtcttgaagttcagtgaatttttttttttttttggtctgattgggacagccacgctgcagaatttctatttgtttgttttaaagtataatttttgtctctttgttgatattattattttgttcatatatctttttctcaatttcctttagttctttgtccacattttcctgtagctttttgagcatatttaagacaattgtttaagaagtcttttcctggacagtctgatacctatttttcttcagggatgatttctggaaattattttgttccttttattgggccaggaaattattttgttccttttattttgccatattttgccattttttttttatgtcttgtgattgtttattgaaaattgggcattgaaaacacatcaacctttccaatcttggcaggttgacatggaggagcttcactaatcagggggcctttcagcctcgggatcagcctgaagtgaggcttaagatattctgaggtcttttaaaggcatatttcgtggttggacctgtgtgagatttaaaaataaaatcttccctctccacaaaaatagctgctttaaaatgtcctaatttgccagagagtctcaccccaggttctccttggcaaattagatgctttatcagatttctctgttaaaaatcatttgcccccaaatgtctatgggtctatagtcccccttaacattttacacaccacagtacctgccactgccttccatgttttccaccagcctgagttacaaacaatgttttcattttctgtctgagctccaagtcagacacgacagcaaaccatcctgtggaaagcccacagacaagttagaacattgcgagtatgttgtgctcttctcctcctagctccagggaggaaactaggaattaggacattttctcccaactacaccacagtggaaggggtgaggtggggtgagtaaaaacaccacaaaatttcccaccgtttgactgtggctttttttcagtgggaattcacttggtggctgcagatctttgactagttttcagagctcatataaagtcattttagtatatctgcagatattttatttaatgtttcagtggggaaacaagggtgtagaccttcctagcctgccgccttgctgactttactgctgttcagcacttttacatagtacctggcaaaaggaaggcattgatattatgatgttttctaattatgtgcacattctcaactttttcctgagggtaataagaaggacaagcagcactgggaacaaactggagaattgttttaaatgactgcgcagagaggagatggggtttgtgacaccccttaaattgcactatgcacatggctacttaaaatctttggtagggtttgatttttctaactgagaacattcattagatgcaaaaagaacccccaaactgcctctagtatgtaactcagaagtagaatatgtgggaatcataaaattaaaaatggagcttataaaaactagaaggctaggtttaaataaagaataaaagaattaacactaactatttttggtgttttctgttctaagaagactaattgcatgtccagggtagtctggtagcaatttgagacatggtgttttaagaactgcattgttttaaatctatgaaaaatcagtagttaactttcctcaactctttgtgggagaagagtgattttcgggttggtgaaggatgcaagacaatgaacttggagcttcgattaatgagctttgggtttagggttgtgtaagctaagccatagaaaaacatattgttagttagtgggacaaacttccaaaggtgaaaatcaataatccagatgggaaaaaaaaggtgaatcccacatacttgttttccttctctctctaaataagtgatgagaaaaactggggactcttaaaggccagtctttctttttatccaactctggaccactctgtccttttttatagtatcaagaaaggaaatgttgataagtgatacatcctttccatcatgatgcatttttctcagcccagtaaagataaatgaatgtttgaccttattcttaaagtcctccaaagacatcgtgatatagcttccctcaaaaactcttttatgatatttatagtcagaatactaataatttgcttatttcccctttctagactctgtttttcttttattctattctctggaattattaataatggttgatcagcatcttatttaagacaaattgcatagatcagaaaatacttgaattctatcccagtcttctattcttccagctacatagttccaaaactcttcacccttttacagcacagaatcaatgctcaataaatattgatcctattttccaatattctaagcacttcggacggggggaaaaactatagatcatgcctgtgtttattttgttgctaatctatggctttgaaccccttcagggcagaaagaagtctcacaaacagcagcaaagaatagtgacagactggtctttaatatcctcctattgctggacctatcatctggttaacactacatttttagtaattcagatctgagacatagtatcaaccaataggtttatatgaatttttagaactcagatttcagaactctcagacaatttggttcaaaacaaaaatgaaacttgatttccacagaactatcatgaccctagaaacaaatgagacttaatttggtccttctgatatgaattcctgcaattctaaggagaatcgccgactatcaggattcctgtttcgggaatgcagttggatcagatggcctctaacgtcccttccaaacccaagattaggttcttgtgtgaaactacagcagacagaaattctattttttccaccagatttctgtggggatgcatttccttttatctaccttcaaatatctcattaatatcataactttagacatccatgtgtttgagttcatatgtaggctctgtccgcaaacattcatatttattttgctattctttcttctccatctgtaagatacatccccatgttatttgtggacatataagacccttatctgtggcaaagcttgtgccacgtgaggatagagtcatcagaaaaacattttgaggattcaaggttggtgagtggaaccctggaataaagtaagaggttgtggctgagctgtgtttaggaaactggtgcactgagcaccagccacagatttcccaagggtagccagggctgacagctcagcacagggaaattaaaaacagtgaaattttaaaatacacatcaattttaatgcaatctatatgtttggcttgtcttcatttttggcatttgtcagaggagaaataagatatccttgtaggaaaattaaataaataaattgtaccctatgaaaaagaaaagcaaagcaataaattacaaatgcttttatttcttccgtcagagtttaacattctagcatccaatcaaaagtttgaaagtcccttttctatgattatagtacattagataaatgggtttttaaaatgcacgtatttatttagaacagaacctcattctgattaagttttcaattcagttaccacctactttatttttgataggcttcatgggagaagatttattttatttaatttatttttgatgcttcaaacattgctgaaatctggtgtaatatgaattgttttgatttccaaatgcaattctgctaaatctagacagggagaaagtgatatttctgtttactttcaactagagcatccagttcgatgtgtctctgagcctttgtatgtggcacagtaaaaagttttgggtaagtaaacagggatctggacctgaaactatgtttcattaatctacagacaagttgctgaagatagtatacatttggttaagatttcctggctacttttggttgaggttgaggttttggtcatgagtagcagacccataagttagtcttaacttttatacaaactaattttgggatgctaagcaaatttcccctagatttttagcaaaagccttggagctgatttagatccagcctcacatttgacagaagaacacatcaaggtccactgtggttaaatgtctcactcaatgtcatgtagagatgtttgtagtagaattgagatttgtctttgtctttttaatttacttttatttaaattaaataaaatatgagataagggtctcactatgttgcccaggctggtcttgaactcctgggctcaagcaatcctcctacttcggcccccaaagtgctggaactacaagtgtgagccactgcacctggcctgtttttgtttgtctaaatgtgtaatactctctccactttaccagactatctgctatcatactatataaactaattgaactccaagataatagcactgaagtgaccaattttatatgatatttttaattaagaaaaaaatagttcttaaaagaactatttttaaaagatataaaatgaattattttaaaagacaaaatgaattattaaaatgctaccactgtttgtgcattttaatagattttaaagtttctctgttgagattttctggttattcatgtatttccctttctattcttgagcatagttataataactactattaaaatacttgtctactgattccatcatctgagttgtcttggggttggtcttcattgattaccttttctcttgattatgggtcacattttcctgtttcttggtagtctagtaattttgattatattctggacattggtacaaaactttggattctgttatgctcttctgaatgtattgatttttgttctttggttttagcagacagttaatgtggcaataatcaaagtccaacctctgtgttctctgtggtgggcagcagtaggaatcattgtggagtccttttggccttagctggtttgcttgtagtcttccctgcagaggaggcattcagagatcagccagatatttaaaccgattttttttttctagttggagttttgctcttgttgcccaggctgggctgcaatggtgtggtctcagctcactgcaacctccacctcccgggttcaagcaattctcctgcctcagcctccaagtagctgagattacaggcacccgccaccacacccagcgaatttttgtatttttagtagagacagggtttcaccactttggccaggctggtgtcaaactcctgacctcaggtgatctgctcccctcggcctcccaaagcgctggattacaggcatgagccaccacgctcagcctaaaccaatctttaaatacagaatttagggctttccctttgtgtatatcttttttctggcacctctttcctcattttatagctgccgtggtcacttcaaactctgtcctctgtttccacaagccagtgagactgcaggatatctactgagttttagtaattccacttcatgctcattggggctgccttcaggcaaaagtccatgaaatattgaaaacttacccagcatcatcccatttccttcttctaagtgtaaattttcctcagcatttccctgcttttgtttgtttgcagtaccttcaggtagtggtttttctctcctttaattttgttgtgtgtatccagattttatagttattatctgtgcaaagattgttctgttagaagctactccttcattgccaaaatagaaagcagatttttaaacatggatttctctcaggaggaaatttttacaactatttttgagttctagtctcccttttcccccgttagagacataaaataaacactcaatataaaaatgggagaaaatgttatataacatatgtgttgattacatagattgcatatacatatatatggtatgtttaatgcatatactttatgtatacattaagtatagagaacaacatattgatattacatacttttcagaatgtacactgtctattcaataattcattttgtgatgagtgctggcataccagacctttgatctgaatgttttttgccactgtctgtggaacctcacaatatcacattgagctatccaggacaataactgtcactccaataggaccaccacctcttttctttgcctatactgtcttcacttttccttcacgttgtgttctctgtttccttttccttgtggaagtcacagggtacacaaggattgtgacctacccaggctagtcttcagagttagcagagcatctctttctctctctcactcgcttgtttttttttaaattccattttgtttttctatttattttagacagtcccatttttctcagagatgtgttgatattctcactgagtattccaagagttttcctgcccagtctccatattatatcccagaattaaattagaaaggttgattacagcttttttgcccagtgagtcaatgtcaaagtgagaaatcttaaaaaaaaaaatggatttgtaccgatgtgtcattgattgctggcaggaagatcaacaagcttttcagtcactctagcatctggttgtagtatttggagaatacctgagaataactactctgagaacagtcaggatgattttgactatacctaaaagtaaacctaaattaaagaacttaatcaatagatgtttattatctctcatcactctatgtccagagtaaggaagcggcaaagttggttaattgactatcgcagtgatgtgaagactttgtatgagcttctcagcaattcttctggcttttgttcttatggtcacaaggtaactgcatcaactcttagcataagacaacgcccagaggcaggaaagtgtaagatatgtgcctgtgcctatttttcatcaaataagaagacattttcccagatttccccataaacagcctttatagcctcactggctagaagtgggtcccatgctttctacaaaacaattcatgacaaagaagaatgggattaccatgattagcctaaaccaggtgttgaatagtggttgaattgtggccccccgacaaaatgcatgtttacctggagcctcagaatgtgagacattatttagaaatagcgactctgcacatgtaattaattaaggatcttgatataaaatcatctaggatttacagtgaaccccatttccaatgacaagtgttctcataggatgaggggaggacacagagaggaagccatgtgaagatgaagatagagactggagtgatgccgctacaagcgaaggaatgtcaggagccaccagaacctgagggaggcaaagaacaattctctggagcctttggaaccttgatttcagacttctggaggccagaaatgtaagggaacaaatgtttgtcctattaagcctcctaatctgtggtgattggtcacagcaaccctaagaaactacactataccagagtttggcaaactaaggcccaccagtcaaagcctgctgttacctcttcatataaatccggttttattaaaacacagccacacccattcatttacacattgcctttagctgctttccaagacaatggtaaagctgagtagttgttacagagactttatgtccagcaaaacttaaaatatttactctctgtccttttgcagaaaaaagcttgttgatctttggtccagagtaatagtggttcagctcctagtgctacagagaggtacatcttctatgatcatgtcatttctcaacacctgaacaaagggaagttcttttagcaaagaggacagggatattttttacagataggaaaccaaaataatcatgaacatgtgaagactaaacatggattgtgcataataataaactaatacttgttaattatccacacttgtagttttaatttagaaaactcaccatatttataggctcccaggtggcttttgttattatgtgttattatttgtctgtatgtgttaatagattacaaatttggcagtagagataaaccacaatattcattgtgatcatgttgatcttgtgaattgtgtatacaaaatatatgttacaaactttcctttctgtattcctggatctctagatgatgatatccaagacttgggtttaaaaatgctagacatttctggactgggtgaggtggctcatgcctgtaatcccagcacttcgggacgctgaggcgggcgatcacctgaggtctggagttcaagaccagcctggccaacatggtgaaaccccatctctactaaaaatataataattagctgggcatggtggcaggcacctgtaaccccagctactcaggagactgaggcaggagtatcgcctgaacccgggaggtggaggttgcggtgagtcgagatcgcgcctttgcactccagcctgggtgacagagtgagactctgtctcaaaaacaaaaaaacaaaaaacactagacatttctacaggaataaataaagggtggtaccgggacaaggttagacatgtagctcatggaatagaattgaatgttcggggaaaaaatgcccaacgtgttatttatggtcaactgagttttgacaaaggtaccaaggcaatttaatgggtaaaggataatcttttcagcaaatgataatgggacaactgaatatccacatgcaaaatgattaattttgaccactgtcttatatcatacataaaaaacaattagaaatagattgtagatttaaatgcaagttaaaactataaaacttctagaatacaacataaaagaaaatctttgtgatcttgggttatgcaaagagttcttagaaatgataccaaaagcatgattcacaaaggaaaaaataatacattggactttttcaaaatttagaactttcaggcttctaaagacaccattaagaaaatgaaaagatagccacaggctgaaagccaacatttaaaacttacatagctaataaaacacttatacatagaatatataaaaatacttataactcaacaataagacaaagaactcaacttaaaaataagcaaaggatttccattctaccaaaaaatacttgcattgtatgttcatcactgtactgttcacaatagcaaagacatgaagtcaacctaagagcccctcagtggtggactggataaataaaatgtggtatatatactccatggaatactatgcagctatgaaaaagaatgaaataatgttctttgcagcaacatggatgcagctggaggccattaacctaagtgaatcagtgcaggaacagaaagttaaatactgcatgttctcacttataagtgggagctaaatattaggtactcatggacataaaaatggcaacaatagacaatgggaagtcattgggggagaagggagagaaggaggccagggctgaaaatgaactattgggtactgtgatcagtacctgggtgatggatcattcatacctcaaacctcagcatcacacaatataccaggcaacaagcctgtgcatgtactgcttgaatctaaaataaaagttaaatttattaaaaacagaagaccaagggatttaaataggtatctcttcaaagaacatatttgaatggctaagaagcacatgtaaagatgcttaacattattatttattagggaaatgcagattaaaaccacaatgagatgccttttcaattgaagaaaaaaagacagacaataacaagagctgacaaggatatggggagcctggaactctcatacattgctagtgagaatgcaaaatggtatggatactttaaaaatgagtttggcagtttaataaacactttaatgaaaacataaacttaatatatggcacagaaattctactcctaggtatctatctaagataaatgaaaagatatgtctgcaaagagacttgtatgcaaaagttcatagcaaaattactcatacaaaataattgggaacagtgcaaacgttcatcatctggtgaatgaataaagaaaatgtagtaatctatgcaatgtactattcaacaatagaaagaaactactgaaacatgcttcagcatgaatgaatcttgaaaaacttatgctgtataaaaaagccagacacaaatgacaaaatgttgtgtgattctatttttatgaaatgtccagaaaaggcaaatctatagagaaaaagtagcttatggttgcctgggactgcaggatgaaaatggagagtaacaacaaataagaatgaggaatcatttttagatgttggaaagggttctaaaactgaattgtggtgatagttgcacaactctataaatttactaaagatcattagcagctgggcatggtggtgcacgcctatagtcccagcaactcgggaggccaaggtgggaggatcccttgagcccaggagttggaaattgcaacgagctatgactacaccaccacactacagcccaggcagcagagcaagaccctgactctaaaaagaataaaataaaataaactagttatattatagtgggcgggtttatggtatgtaagttatacctcatcatgattattcaaaaatatatagtaagggaattttttaaaaccctgcaaatatctaacttttgtccaacagaaaacacggatgcaaactacaaaggatatcacctgtatccattgctatttcaactaaaaaactgattacaaaaaggctaaagggagattgggagttctgttcttgtcagagagatgcttaaatctcataaccactgtgtagttcagagtgacattgtctgagcttcctggcctcctacagacccagtaagcagaataaaaagatgagaatcttattagcagaatgagcagaacatacttctaaagttttgctctatttctttaatctttatcctatcccagggaggtaggcggaacagatatttttgacccccttttagatcatgcaaatcacagacacattgctaagagacagtcacatctgactttttaaacagtcttggcagcccccccttccttctcagccccatcttctcatcctcccaatcaactttatatcttccaccaacattgcatttaaatccctgcttgtttctcacttttccttttctcctcagaggaatagtaaggctataatccttgagccaatctttgcttaaaatgtactctggagtgcatagaaagccagttcaaggacaactttcttagccaagggggaaattacattttctgcaatttattttgttattttgtgagtttctctccttttcctaagttggatccaactgaagttaaattttaccacattctccagatgaaaagtgatgatagaacttagttgcaaggtgtggaaacagcaacaacagcagcagcatttgctaactgttgggtaaatgctagacagtccaggaaacacgttgcctgggtgatctcctttactccccactccagttgatgaggcaggtgccattattacttctactcacagaagagaaaattggtctgggattatgtttagccaaaaagtggcagagagcaggtctgcctgagtttaagcttatggcatggcataagctcatgtcaacagcccctttacagaaaattgacttcttgtcatttaacccaaacccatgtggagagaggaaattggtctgtggtctcttggtgacctttcatacctgaaattgtgtagatgggttatggtggtctccatccaccatccaggatcaccatggatatggtctgtggtctcttggtgacctttcatacctgaaattgtgtagatggggtgtggtggtctccatccaccatccaggatcaccatggatatggtctgtggtctcttggtgatctttcatacctgaaattgtgtagatggggtgtggtggtctccatccaccatccaggatcaccatggatatggtctgtggtctcttggtgacttttcatacctgaaattgtgtagatggggtatggtggtctccatccaccatccaggatcaccatggatatggtgtgtggtctcttggtgacctttcatacctgaaattgtgtagatggggtatggtggtctccatccaccatccaggatcaccatggatacagctgcatgcaaaaaaaaccaaaaaacaaaaaactcaaagttagaaaaaagaaaaaggaaaatgacatggtttttcaatatcatgatgaaatgttattaggcaatttgaagttaatctatttctctagggatgcaattgtttgacttagtatttattattgattacgatattttgttaccctgtaagtataaatatcaacttttatatgactaataccaacataaatttttcttgtccaaagcaagaaaagataaccctagaaattatttttttgttctgtgggacattaaccagttttatatttgatttagcaatcttcttctaacattttttcagacctatatatataactaactcagtctctcaaatcatctttgaactagctttactcttcttttgattctttcattaataagttaaatatatctttgatatgtgctcacttaatatttgtataagagacatgtttaaggttttgaaaattatactctgatagctttaagcttgttgagagtaagaaactaactctttttttctatgtcaccaaatgactactaccttgtttctctctctaaggccattaagcagttcattctctacgtcctcctctgcttaaacatgtttagagctagcaggaagaaggctgcagcctgcttttccactcctcgctgctgcttctacttgagacatggagaagcatttagaaaaggccgtgtctcccctgttctcagaggtttccagtgcaaatagaggggaaagccagtatctcagtgctgtaatccttctgatcttccgagtctcaggcatgctgctcagtaacagcatattaataagacacccaaggctccctttctatttagtttttttgtgtgtttggagacagagagtctatgttgcccagattggtcttgaactcctggcctcaagtgactctcccacctttgcctcccaatgttctgggattacaggagtcagccaaggtatccagtccctaaagccctgtttctaaacacagggtgtgtgctgtggatgtcaatactgacttttttacaggtagctcaatagctaggacagaggctcagccaccttgaattcttccttctgacaaaagaagtgctgcacacacaacgcttaacatacttcagagctaaatgatcccgtttcaaaatattagtgcctggaggaaataataggtgttaactgcagcaatgaaggggtgaagtaacctggttactaatgtacaatggggcctattatttccagccaggatgaagtgttgtgagtctgattaatgagcaatgctgcgcatgtttcaacaaggaagagagaataggagcctacagttatttctgccaaagccatctctgcatctgttggtggaatcacttcaggatcagccttgtgttaaggaggcagcttgatgttggtaaaatgagaaggaatctgaaagctccaggctgaatcgccagcagatctcagtgaaatgacttggcatgatacataaaaacacccaatgtggaacctagcactttcctaaaacagaaaggtgctgtgaagctttcctataaaagattggttggggctctttcaagcaccctgaatctttagagtggttgatcacgtttatttcccagatgggtatccctgccatgaccctgaattgctgtgatggtatgcaactattacaataatgtgctgtctgatgttcttgtttagattgtctgcgttttctgtgggttcagtttttcatttcatcacttttattttgtatctttcttttattattattgttttcatttcacaaatattacatgaatatcttcttgaaaaagattcaaagaatagctattgctattaagtatcatgtttaagtccatattttcccattctctgctttccaaccaaacgcacttctatttctctgtcaagcaagacccattggtaatagtgaaaacagtttgctgtgtgtcttcctagtctcttctaaatgattacacataaactcataagcttttttcttctttcttcttaccttcttccctcaaaaaagacacacacacacacacacacacacacacacacacacacacgtttaaatatgtttgcttttgcaatcgtttttcagggaacagtaggtcactatgttttgcaactgttccatatcagttcatattagtttagtaagaatggacctacttcctttttattaaagattgaatgctgttttattgcatggattttccccaaattgtttcactggaagcctatttactgacatgtatgttgattctgagattccactcttgcaaataatggtgccataagcattcttttgtaaatgtctttgcatatgttaactatttcttaatggttattttcctggaagtggaattcttgggtcaagtagtatgctttaaactgtttttaaagaggccaccatattgcactaaaaagactatcaatttataatgccaccaagaatatttgagaataaaaagtttgtctcacccttactaacactgaattattattgacctttttaaaagatttgtgccaatttgatgactgaaaaaacaaaaacaataaaagcatggcagggtagtgaactggtttaggacctagtcaaattcagtttaaacccaagctccactgcaactagctgagtatctgtgggcaagttattttggttctctaggcaacgtctcctttctttgcagtaggaaaactactcactataaggcttggttgtaaggcttcaaaattagcacaagtgaaccctaaaacagtggctggccagtagcaagcactcaataaacattaggtattattattattagcattttattaattttagtagagctacatacatttttatgtatttattgaccacctgaaatttgtatttgaattaccttttaacataatttctgttctgctgagttctttaacaattaaaaaaataatttggaagttctttatacacatatatatgatatagaacttttgtcttatttgtatgttgaaaatatctttcaaagatacttgcgtgttttttaatgttgcatatacatttttatttttaagttaaggaagtttataattcttctttcatcaaatctgtccactttctccactatgacttattctttcaaagtctacttaggaaacttccccaaacaagacttttaaaacaaacaaacaaaaacacaacaataatcataaagggttgtttatttattattaaatatttagctctctaatccttttgaaattataaaatgtatggtttgcatgtagtgtgagatagaagatctatgtagtttagttttctatgaaacagtcatataaatagtatatcctgtccatatttacttgaagttatatcctataccttaacaaaaataaatgcccatgaattcatggatctgtttcttaattctcaaattcggttccatgtatttcctttttgtgtcaatagtccaattgtttttattacaataggcttttttttcatgtgataataaaatgatagagaaattacctaccatttttttctttttcaaaattttcatgtcattcttgggctttttttccttctccaaatgcactttactgtctgtgtgtaacagaaagagaggcatagacctggatttatttttaattacaaattctagtttataatttgtgctaacatataagataataattgatttttatacatgaggatgtgtctgtctccttacagagctttcttattttaatagtgtcttattctaataatttatctgtaaaaccctcaaattcttttagatgtaggcaatcatactgcagagaattatgacaatttcctgtttctttgtgatgtttatattatttatatatttactttgacatttttattggctaagcctgtagtgtaatatggaaagtggtcttttgttttttcttgctccaagctctaatagaaatcatatatatatatgatttatatatatatatatacacatacacactcacacacacacacacacacagatatatatatatatatataattgctgtaggtttctgtttttttttttttttccctgagagggagtttcgttcttgttgccaggctggagtgccatggtgaggtcttggctcattgcaacctctgcctcctgggttcaagagattctcctgcctcagcttcccagttagctgggattacaggcacctgccaccatgcccagctaatttttgcatttttagtagagacggggtttcaccatgttggtcagtctggtcttgaactcttgacctcagttgatccacccacctcggcctcccaaagtgctgggattacaggcgtgagccaccacacccagccaaatgttgataataatcatttctttctttctttttttttttttttgagatggagttttgctctcgttgcccaggctggagtgcaatggcgcgatcttggctcaccgcaacctatgcctcctgggttcaagcaattctcctgcctcagcctcccaagtagctgggattacaggcatgcaccaccatgcctggttaatttttgtatttttaaactagagatggggtttcgccattagttagtcaggctggtctcaaactcctgacctcaggtaatccacctgccttggcctcccaaagtgctgagattacaggtgtgagccactatgcccggcctggtttctgcttaaagcttttataaaattaaagactttccatctgtttctagctggctaaaaagtttgttggtttactcaggaatagtcattaaattttaccaaatgcttttcaacttttattaagattattatattggatttctcttttaatctattatcatatctagttacattaatggcgttctggatattcagccattttggtattcctgaattaaatgtgcttgtcatgatataatattcttttaattcgtagctggattggacttgctcatattttatttaggaatcttagagaaagaaaagtgctcctttagtttggttttattataagacttaggttgggccgggctcggtggctcacacctgcaatcccagcactttgggaggccaaggcgggtggatcacgaagtcaggagatcgagaccatcctggctaaaacggtgaaaccccgtctctactaaaaatacaaaaaattagccgggcatggtggcgggcacctgtagtcccagccactcgggaggctgaggcaggagaatgacgtgaacctgggaggcggagcttgcagtgagcagagatggagccactgcactccagcctgggcgacagagtgagactccatctcaaaaaagaaaaaaaacaaaaacaaagaaaaacaaaaaaacaaaaaagagttaggttggcctcataagcatttcctattccctgaaacagacggaatttttcctataaactcatctaggtgtggcatggtggagtttggtttgtttgtttttatttttctttgcttgaggttggctttaaaaaaaaaaaaaaaacatcttttactctctggacaccaacagggagtccagtgcttcaactcaattgtgacgctgcctggggctagcataggacctgcaggttaagggctcagtcccacaagactgccccacttcgggtgccaatcacaagtcccaggtttccaccatacttctgaccaacctgccacaaatcagggttcctgcgactcttctcaggttccataatttgttagaaaggcccacagacctcaggaaatttctttacttattattatcagctgattatacagaatagaactcaggaacaagtaaatggaagggattcgtagggcaaggcatggggtgtggtgtgtgggggcatggagcctccatgccctctccgggttcacccctcccagccccttgatgtgttcaccaacctgggagcactctgaacctattaatacttaggggctttcatgaaggtttcattacataggcctgatgtattaaatcgttgaccgttggggatcaacttcatctccagctcttttcccctccccagaggtcagggatggggcttaaagttgcaaccggctaattatgctttggtcttcctggcaagcagcccccctcctgaagtgacctagggccctcaaagagtcacctcactaaaaccaaagacatactcatcactcctatcagaaattatggggaataaggtgcaaagatcaaatatctatttcttattgtgtcatacctagcattcatttttccatcctttgttattccctctgtttcttttaatttcaggagccctcttgtactccacatgtaactgcattttatttttcagagtttaaaatgaacttttttctgtgattgctgatatactttaattttactggttttgtttgcttgtttgtttgttttttcattatttgtttggatcttgcctgtggctgaattgattttatattttgttccattatattccctcccttgtgatttgaaatttatatgtctatttatattcttctagtggttacacttatatttttaacaattttaacaattctgtcgacagctataacatctatatcctcctcttacataagaataaaaaatttagtattcttacacttctcaccgctctctctggcagactccatggttgagaacatctgggattttagttccagatggttattttatacatttttaaaacatcaagcatcaacagttatttaaacttgactataacttttagtgttttatttgattactaccctttcttgtatctttttacttggttttgttttttattttatgggattttccttatatatatttttttccctgaagtatttatggatggcaaaatttccaagtctttgcaggttcaaaactcttcattttgtcctcatacttgaatgcaagtttgccagggtgtggagtataggtttaaaataaaaatctcggatcattttctggtagcattcagttttgctgttaaaaaataagatgtaaatttaatctctgtattattgtaagtaatctgttattttctctttggaaatttttaaaatgagaggggagaggtgagcggggttgagaggggagaggtgagcggggttgagaggggagaggtgagcggggttgagaggggagaggtgagcggggttgagaggggagaggtgagcggggttgcagaggttttgaagtgcatggcgtgcttagcaaatattaagtgatccattctggttatcctgcattcaaagcggaagggaagagtcggttggctgaggtgtgagaggtctctgaaggaaatgtgtaccagaccctaattgtcttctgtgggatttctccatgaaaggacctgcaatttcccaagtgcacatgatgctgaagcgtttacactgtggactgcagcacatcttgactccccaggaagagccaaaaaggtgatgcccagagagaaagtggaggaaatagcttctgcccgccatctcatcttagcccctattgatattattaggttattgataatggcttccgtctgtggcaggcagaacaagctccacccttctgtgtgtctatctaatgacagcattcggcttgcctgatacataacaaactacaatctgggtcctgatcattaggcaacatcatcagttaacaacaaataaatgttggtttattgtcagagaaataagatgtcgtataaattagatagatgtgctaaaaacttaaacaatcattaggcttagatgaaaagaaatgaagcaggtgcttctgtggttcataagggtgatggctgggctcatgcggatgtgtgagatgtgctaccctggaaactggttatgacgtcggcacattacccatctgacataaaacaagaacaaaaatgtagccatgagtgtgtataaatgaatcaaaatagaaaagcattccatcatacccctgagtcctaaggaccgaaaggtttaggtctttgcagttacgcgggggttttcacataaagtattacccttgctcctcagaagaaccatgcgagttcggttctattattatcctcactttacagcttgaagaaactgacaattttagtaactattcaaggtcacacagctagtaagcagtggaactgggccctaaacccgtatttccctaattgtatgctctttcatttttacagttagtccttgatacaggacatagtacgtcctggcactcacaaatgtgaatatggaaacttgaatgtgggatgctggactctgagatcacatttgtgagcttaacagcccagaacctccagatcctgagaaaattttaagtgaaagatgagcggagtgaaactgttaactcatgcaatatgtggattttgactaaagtcaaaataggggaattctatcaatataaaagccttgggatgaggggaccgatcacaaaagatggccacccggttccttacccgttgcctcactatattccatctttcattttgccaagtcaaaaatacaccaaatggaggaaccaaaactaacagtctttttgcattcatttatgtaacaaacagttcctaggtttttgttattatttttcttctttttttgaaagggacaatataagcaaaatagtattttgttgttgttctcattgcagtaggtatgttagcatttttttttaaatttgagaatgaacaatttattgctagttttaaaactcatctactacacaatcctcaattgagtattttgtgactacattttgtgtatatgtttgtttgtggttgcacgtggagtgtgtgtttgagaatgcacatgtgtattttggaaatcattatttatagctcttaattaaaaatttttaaaggaactatacaggctcagttctttgttttcaaatgtgagcagctgaaattagatccctcttacacctttgccagagcaaaactgtgcaatatgcgtaatgtgctcttgtcccctctagagaggtggggctagagtggaaatggctaatcctcttcacggggcatgaattggaaattgagttttgcaaacaaagtcagagataatgtcagagataatttcccatcttcattatttatggaaatcagttactgtattttaattatccactgcttgtatcgtccacataaaatgcctttccttttatttaaactgcaaataattgccagtagaattattcattggaaattggaatccacttttttgatctctagaaagcctattaataatgaatgaggatgttatttatttgttacaattccacaaatggaaactgaagaaagactctatattcctcagttatctcctctgacaatacctgagtaaactcaccccaggagaaatgccaaaatgtggaaaagcaacataaagatgagaacagctttcttttttttcttctttcaacaaatgaaatgcctactcatttcaacaaatgtgggcctactatgggaaaagcactcctaggtgaagtcagggagaaagttaagctagacgtgaattttatctttcaggacataataaacattcataaaatccttgacatttgcaagcgatataccctgagaccttcatcaatccccatattcatgaatcttactatagcatataatttgctacataaaatgcaataaaatataactgaaaaatataagtgacccctttggacccttaatgattctataaatacagaactcaagtaatttataaagctattaaaataaatctggccattaacataaactctatgctaggctatctctcacttgaacaatttttgcactatccagagaacttgctaaaatagcttcataaattgctttttccagtttctgtacagaatgtatggtggacctttcatgtctgcactactgcagaatctgaatctttgcttttaaatgttattttaaaaagtatgtattatatgaaataatatatattatattgaatatatattaaatatatatatgtgtgtgtatatatatatatatatatatatatacatatatataattttttttttctggccaaagccatcacttgattggatctacttatttttctcttcatttatattaccaacagtagaagccaattttcttactagaaactttttccccctcccattggaagaaccaaagtttgaccacctttttagcctgtgtatggagctaagcagataaacttggtaatgggtgccctgggccttcccagctgctctcacaagctatagaagtcacttctgaacttcagccatggagtattgaattcaaatttgggcctcacaaaaattaaaatataatatccatgatgaaatttgaagcctttgtaaatagttgaagtgctaacttctatacacaaatgagcaaggtctgatatatattcaatatgagggagaaagtgacaaatactcaaaggaaagatacaggtaaacttaacttcagaagctgcaggggagtttgaggaagactacagggaggaggcagcacttttccggactttgaggataggtaagacttagaaatatgtcacagacatagacatcatagacattttgagtagaggaaacagaataagcgaagacgtgagtgaggaggcagggagctttcatgaggaaagtgaatagtgtaatcccacctaactataaaggtaatttctcctcaatgtaaaaatacaaaaaaatgctttcctttttttggaaatatggtaagatgaggcatacacagaaataatcccagtgtgtttagaaatactatgaaaaatatatttaaagtattttaaaatgcatagtgatctggcaagaaagcaagggaaagttcaagaagcacaaagcaacaaaacaatattacttcagaaagataagctatggtgaagccggttctgccctaggatggcttctgatgcctcattccctagagtgcaagtttgagggattctgtgtggatatgagctaaagcctgggagctggtaaaatggccgggaagattacagagtttatcctggagccacagaccctaaaggcaaaaccctgaagtgggttaagggggaagatgtgccttgcagaaggagagagtgggactacctggctgggttgaagatgtctctggatggaggggcaagagaggcttcttgggatccttaactggaagactgctctcccatgagtgttaattcacgactcctgtgtggctcccatgtcgtaagcttggacataggttggtaagacttcaaatccttggtaaaaacaaggcaaatcctcactgaaggaatgcactttaatcgcaggcaccgctaacatttccacaattttgtaaaacatgtagctcatcacgtacatgaggaaacagaccaccatgaagaaaagtcagtgctcatagtatagtgtagaaaaggaactttgaaaactacaactggggcaatttttcaaaagcagaatataaaatatatgtgtgtaattatgcgcaaagaaataaaaatggctgtcagaatataatttaggattaagagaacattaaaatccatcagtaatatttttttttttttttttttgagacggagtctcgctctgtcgcccaggctggagtgcagtggcgggatctcggctcactgcaagctccgcctcccgggttcacgccattctcctagtaatatttttaagtaaccaaataaaacttcgtagaaatatgaaacgtaataattgagagtaaaatttcaatagatggatacaaaacagattagttccagctgtggaaagaattcatgactggaagataatcttgagaaaataaataccaaaaatctagaatagagattcataaacttccttggttcatggcaccattcatgggttagtgcctgaatgatttttttatagtatccccaaagcaaaagaaattcccaacatttcttttattaagtagttaggctcaaacaacttaattttagtattttgcatggtatataacgaacagctgtgtctctctcaaaaatgcaacattcccacagtgttcctgtgaattcactctggtttcccagtatgccttcacctgtagtttgagaaccatggatgtaaaataaagaaacaaaaaaatggaaaatgtcaaagacaactgaaagagactcccatgtaggtctaacatatgcctaattgaagttccagaagaagaaagggaaaagacatggcaagacaattttccagatttaacacaaaattcatagattcagaaagaacaacaaattacaagcagaataaatacaaaaaactgggcatggtggctcgtgcctataatcccagctacttgggaggcaaaggcaggaggatcacttgagcccagaagtttgaggccacagtgagctttgatcacactactgcactccagcctgcagtaagatccgattaacacagtaagtccccatttctaaaaaagtgtgttttttttaaaaaaatagatacagtaaaatacatatctagacatattttaccaaaactctagaacagcaaaaatagaatgaccttaagagtaaagacagactaagaactgatttctctttttttcctttccaacttttattttaggttcagagtgttacgtgggtaaattgcgtgttgcggtggtttggtgttcacattattttacattcaggtaatgagcatagtaccttgcaggtggtttttcaatcctcaccctcctgtcacaaagcaccttcaagtaggccctggtgtctactgtccccttctttatgtccgtatgtactcaatatttagctcctgcttagaagtgagaacatgcagtatttggttctctgagaactgatttcttagtagtaataacgattcctcttatccagagagaaccgtacgtattttgatatattttcttccaattttttacctgtatatgtcaaatgaaatatatacttttgaaaaaagtaagttgcaaaaccatatatactgtatgactctcaaatatatgtatatttattatatatattatatataaatattttatatatatatataaaataaattgagattcggcggggcgcagtggttcacacctgtaatcccagcactttaggaggctgaggctggcggatcacctgaggtggagagttccagaccagcctgaccaacatggagaaaccccgtctctactaaaaatacaaaattagctgggcatggtggcacatgcctgtaatcccagctactcaggaggctgatggaggagaatctcttgaacccaggaggcggaggttgcggtgagctgagatcacgctattgccctccagcctgggcaacaagagcaaaactccgcgtcgaaaacaaacaaacaaacaaaaaacattgagattcatacaatacatatggtatttattgtagtaagtagttaggctcaaatgacttaatagtaatattttgtaaaacaaatagctgtgtctctctcaaaagacagataattatatatataaattgagattcatacaatacatatagttttgcatcttttctcaattgacacaatgtgactattttatttacctactcaacaaatgattgtcgaatgacgtttaactaggatttagcgaatgattttaaataaataacatttaattatatgtcaaggtactatactaaatactttataaatatttatttaatgttaagaactgcatgagatagttattattcttattttgcaatgaagatacttagtttgtgttaattttaagcatcagatgtggtacttgataaatgcttttttgcctctgtgtttatatcatattcttaatgaaaatttttagaagtgaaactaacgttcgaaacccatgaacttctaaagttactaataaagccaatctgctttctggtaagattttacctaattaacactgtgatcacacactcaaccaaactttgccaatattgagtataagaactaattttagaggttgacaacttctgataatattttaagaaggttaaaaaatttacctcattttattgtgattgtattgtgattgtaacttctacatttacaaatgtgtttgaatgtttctcacattaggcagtggcattgcttcttgtctgtgatatttgctgaactttcccttggtgtttcagcatttttctctaaatgcattggacggtagtattgtataatatatttgtgtcatgtattcttcaaatatgtatgacttttattttatggtttcctggcattttttcaatccaatgaattgtacgtgtacatttttttcttttctgttgtgcttagattatccatccccatcccaacattagatagttattcacctatattgtctgtaagtgttttaatattttattattttacatgtaactctttaggccatctggaatattctttgccatatgtactaatgtgaagatttatttcaattttgttttccaaatgttgaaccttgcctgtagtgccaacttcttccctatttctttgtttccctttaaagcaatgctcttagtagtcttagctggcagacttcaatttctttcctctttttttaaaacccattgtagtttttagatctcacctctccaccaaaacacctcttatcaagtcatcaatgccttccccattattatctccattggccagttttcattcttgatgtgatttgatctgtcagcggtatttgcacagcttaaccgtctcttgcagcaacagtttcatcaccacaacctcctacctcactggcaattctctcctctcctctgcataatcctgcctctagtgctgacaggacctaggcctctgcccatggacttttctctctatgctcacttctaccccgcttccatccagactcactgctcctgataaaatctgtatattatgacttcagggtctatgatcgtagtctgtgtctctcccctgaactctaaagtatatattaatacaacaaccttctcaacatttccacctagatgtctaaatgagcatgctagatgtgtcatagcccaaattaaattcctgatctttccaaggccgctttttgtgaggtcatctcaactcagctaatggaaacttacatccttcaggtgctcagatcaaacatttaggagtcactcttgacccttctctttttctcatacctcactttcacaccttcagtaaatcctgttgactctaccttctgcaaaatcttccataccatctgcactgctactttgttcatcatatcttggctggattttcgcaatagccttccactggtcttcccaattttagtcttgtttctttacagcctatttttaacaaagaaactggagtgatcatttaaaaatggaaatcagatcctgccatgcctctgtcccgtgccttccaatggcttaccatctcacttggagtaaaaagtgaaatctggataatggtgtaaaagactatatgatccaatccccagctcaccccagtctgtctctggtcccatttcctactatttccctgcctcagttactagagcaagaggaagatttggtctccttcatctctcttgaacacgtcagactggttcccacctcagtggctttgcagttgctgttctctcctggaaggctctgtcccaagatatatggatgggtaactccttcatctttttaaaatctttgctcaaaattagcttcctggagagggcttccttattatcctatttgaaattgtattcttcccccactccttccattccctttccatacccactatgttactcttatcattgttgtatatatcagagtctaattctactcacatttcatctctttgcactgatccttctgtcaattattgaactcgtatgatctgattgaatcactaagattttgttaaacatatttcatgtctggtgtagaaggcctttcttattattcttccttaataaaattcccttagttattcttggctttttatgccagcttaactttaaaagtacttcatcatgtttccaaagaagaaaaattaagctgatttttttattggaatttcataatacagggacattcatgtgcaaagaattaatatctttatatcattcactcttcctttcccagaatgtagtatgcctcttcatttattgaagctcattttctttttgacataggttttgtgattgtatattttctatagttcttacatgtgtcttgtttaagttaatcctacatgttgtagtctatgctttttttcctgctttgttctattgttgctattttattccattatgtatttttaaaagattattttcaaatagttattttttcaaatttctatctatcagcaacattgttcaataatcttattactggcagtagattttcagtttattccttgggtttttgaaggagacataatgataattctatccccttttcatcatgctaccaatgccttgcctaaaacttctgcagagtattgaatggtagtagtggtcactagcctgttggtcttcctctccttgttcacgctgctggtttaaagtggatgtctttgtcacattaagaaagtatccttacattcctgatttacaacgcacttttttgaaaaaataagaaaaagtcgaggtttgtcttgtgctttttgtttccatcagttgagctaatattacctattaatttgattaatagattttccaatactaaactaaataaacggttgcagtgggtggttttttaaagacatactattgaatttaatttattaatgtttcaatgaggattttgcatctatgttcgtaactgtgtctgttccatagttttcatcttggtgttatcttttatccagtgttagaatgggaacttttatgaaataaagtaggaagcaatttgtcttgttccaggatagaaggcaggatgtgagtataatcgtgtgtgtagaggtgtgggcttacatatatatgcacatagatattttcatggagagtatacgctcctaagaaatttgacagaatttattgttaaaaactacctggttccaaagccccaaaacttttttgataatttattgtctttctcatgattattggtgtatttcggtgttctaccactttaaaaaaaacttgatagtttttttttccaataaattgcctatttctatttaattttcaaattataactggaattgtatgtagcattttcttatgatttaaagaatattttctaaatctgttgttgtggcttcattatcattccagttctgctcatttttattttttctatttatcctgttagttttcaggaaacttgcttaattgatattaaatttttctttctaatagtaaagcatttaagatttgtttactactattttggtaagttttgtcttcatttttgtttttttgaaccccgcccccccacccccggccccgctctgcaaagtggcttctatttcagtttgcctttgatcccatattaatttaggaaggtgatttttaatttcctgcttattaagtttttgttcttgtgtttaaattactgttcttatttttctattcttattgtaatgtggtcaaaaaatgtgatcagtgtaatttctgctactaagaatttattgatgccttttttgtgatatggtagattaggttttataaggtccgtggtcacttgaaaatgaggtacttctctaactgtagtgaaggcaagtttttacatttagcctgttaattacattaccaagttatctatatccttacattcattggaggcctatcttatatttgaggatgttaaagtctcccgtaatagtacttctgctagttttgcctcatactgccaacagtttgtttgctttactttctacactgatttttatattttttgcataaatgttcttgaaaattacctattcattaacagatatacctattttcactgtaatatttggcatctataaagttccctcacactttgaattccctttgactcatactactatttctaaccttgctttctgttatgtttttggggaatgtgaaaatggcggcctccagtgtttactgattctgaggctcttcctctttctaccacgtgtgaagggagagaccagggagcatctaaaagagaatcaccattggcgtctgctctctcgctgtgtttctttcctgatgacagcctttgctaagcacatttgtggcaggaggactttggcctccttgcatggttttcaggttggtgtgggcgtcgggggcctggggcagaggaggagagagggtgcagctttctcttttcttctgagcccatcaaactgcaccttcactggtttatcatgagtgcgtcttcaaccttaccaacgcgcagaagttgctcccagattctaggacagggagatagaacagaaaaaatagagtatctctgtgtctgcttttggggagttgttgtgtgtgtgtgtgtttcttttttccttttttcctgcagtgtctcaataaacatttttgtagaaagttgatagagataacatcaggagctgctagtttggttaaaaaaaaatctgctactgaaatgtttccaaaaagatgggtatattcagtcagcactgtattttaagaaccttatctggtctgagtgtaacagagtgctcaactaggagataatttcagctgtccaagagaagttgtcagtctctggttttgggagtggagcaagaagtaagcagacacagatgcattagggagacagaatctatactatggaaaataaatggatttgtatataagtacaaaggtgtgaactgggacttgggtggaaagaacaaaagtatatgaggagtctaaatcaatgctcaacttcctagcacaaattgatgaaaatatttgccacattgccagagggagagtattttcttaaaggaaaataattattgttatacaggaaaaggtctttattttatttttaagaaatgcataggtaagaagtaaaatgcaatgtgaaaatgaattataggtgaaaaatattaaaaatagttaaatcaaggagatgaatgtattcgtgtttactattctctattttgttatgtacagaaaattttataataagcactttaagaaagggaaaaaatcacccagtttggcacctactgtcttgaggtgctgtagacccctactccatgtgataatataggggtggcactgaagatgcaggactagacctcccctgaccaaattgggaggtgtctagttgggtgttgtaaggatagaagttgttggagctattacatgctaaggcagagttcacaaagccactttctaaagatgtaacatttggcaatttgaataacagtgctcaactaacagggctgttgtagggatggaatgctataatgaagacaaagccctgggtcacagaagagctcaacaaaagctgccatgtttcacaattgcggaagggcagtgaacctgcaacaccccaaggagaccacaaaatagcttgtgggtcaagcaaagccaagtgtattgcttcctgtaataaggaagaccactgcctttttagcactgtctttgaaaaggaaggataaagatgagatatttatgtgatttggaggggtctcgtttaaggcaggtgtttctatgaggaggtctgactgggactgggccaaagttgtgatataatagttcaggactggtgaactcaggtgaggattttggagcaaacctcagagtaaacaattggatgattccagctgaacaatctatctttctaagaaggaagctatttactctgatgaagagatgtggaaagtcaatgaattttcaaagttatttccaacttaatcttctgggtcaagaatttcctggaatagtcatgtcatgttaatgaagagtatcaaataggaaaaatcatgctttatggactataagctgtttggctgtagatagtttcagcccccaggggagattatggtgtggattgtttctattttgttttagtatttgtggcatattgctacctccgcagcagatgcatacattgttttgcaaagtttaattaagcttatcattcatttggcaatatgtattaaagacctcaaaataatcttttaactagtagttttattatcagcaatcagtcattcagaatcatcaaagacacgaacaaaagatgaacatagatgtttatcacggcatttttagaatagaaaatacaaggtaaacaaagtgactttaaatgggcaaacagaaaataaattatgatttagccacaggatgggacactgtgtgtaactaggacaaattgtgttttttagaaatagttaatgatgtggaaaaattctctccaagctaagtgaaagtaggacataaaagtgtataaaattatagtacctatgcctgaatgaaaatattgcaaaattttataagtggttatctcagggttataagattacaggttgtattttctacaaacatttaaaataaactttcttcttaacagaaaataaacactattttaataataataatacaatgattgaaagggtggtgtagatgccctccaaggagaaaaggagcttgtttgtgtttgttcctgcagcaaatgatgcaattgaggcaggagagcccaagcaaagggccctcttcagaaagggagacttggctggggttcactctggttttgaacaatgaatcatctcttctgttaataaggattagcaggttataatataggaaatggctcttgccatcagaaaaactgaatatctctgtgttagctcatttgtgttgctattaaggaatatctgaccctgggtaatttataaataacagaggtttaattagctcatggttatacaggatgtacgagaagcatggtgttggcatctgcttggcttctggtgaggatctcagaaagcttccaatcatggcagaaggcaaaggagagccaggttgtcacatggtgaaagagggagccaaatagagggggtggaggtgccacactcttttaaacaaccagctctctcatgaactcattaccactcattactgtggagagcatgccaagccacttaggagggatctgtccccatgatccaaacacttcccagcaggccctacctctaacattgggagtccacatgcaccttggaggggacaaacatccaaattgtatcagtctctcagggcgcttgcaccacaaataacactgagaattccacaaccactcagcaaaggtgtttattcctcttgggttcatcattgcttcctatctttcacagatctgcttttccaaggaattaaattcctttgaggacttctcgttaggacttcttttctccagtttgggagcttctatgactgcttgttgccaggagcctaacagagtgcagagaatttcagtgatttgcctgcagatgcattgcaggcggaactctctgagttatctcctacctagggaaagaagcttggagttactgtccactctcagttatctgcagctagctcacatgaccaacagatgcccattgtcaggtggaaatccctcagaacttcattctttctgcctaaaattccaattgctaaaactgaagacaagaataaggtagaaaaactctagaatgaggcaattaaaatgatcaaggggatgattgagtactgaagaataaagttaaaattcttcaagatgtaaagataaattctgaaagaggatgaatggttataagatcctgaaaggcaaatagaagcccatttctcaattctggagaacacgttcgagagcataagttgaaatctaaaggaagtaagaggaacagtagaggttccttggatggcacagtggagaaggaagaaggaagtaaggcactttgtacacactgtctcattatatgacatgccatcagagcattttgttctagccccagttctgctaccagctattttctggtgatgtcaaatgagattcttcatcctaagcctcagatttcttatgtgtagaatcaggattttaattatttgggtttgagaatactttctgattccaaaagagtttcttttattttgtaatataaaaatcataaatactttattattaatacattatttttgaaatgttacacagactggaaatatgagaaagtttgagagtgtttgcatatatttcctcatgacataataattattaaaaggaaattagtggccgggctcagtggttcacacccataatctcaactactcgggaggctgcggtagcaggattgcttgagcccaggagtttgaggagcatgttcgcaccgctgcactccagcctgggcggtagagcaggaccccgtctctaaaaacagaaatgagtggttcctagcaagacgctaagctaacatgggtaagacttcctctcccaagactcctctccacaatgatagagaggtggggcaagggtttgaactggcgcatatatacatatatatatatatataatgtctttggtctgagagaaaaaatggcctagtatggctttgaagaaaaacttagaaaaagaattatggaattcttgccccatatcttcgtgtttagtggtgagtcccacgacacacttgtcaaaactcagatccctggtacaggggctctcaggtataaaatcagtaaaggactgaagagccctttgtttgcagggagtgaacaacaacaacaacaacaaacaaacaaacacatcggggcctgccagggggtggggggctaggggagggatagcattaggagaaacacctaatgtagatgacgggtggatgggtgcagcaaaccaccatggcacgtatacacctatgtaacaaaaatgcacattctgcacatgtaccccagaacttaaagtataatttaaaaaaaagaaaagaaagagctgtgttagtatctgttgctgcataaaaacctactcccaagattggaggcttaaactgacaataattattgtttctcactgtttctgtgggtcaggaattccgagaggttacagtagggatggcttgtttctgctctgtggtgcctgaggactcagctggaagactcgaaagcaattgatatccagagcattaaggactgttggtgtcattgccacagtttgtttgctaggatgtttatcttggttattccttaatacacaataaggaaggcaagtttcaataaataaagggttcatttagacctaaaagaaacaaaataagagtgaatgactgagccttaacattcaatggttatagaggttgaaactcccagttttcaattttatctctgttgctgaatcaacaatcccaactctacagtttgcaacaatttgttcaaatccgaagaggaaaaataattaaagtgttgtagatagccatagaaatgataatttccgttttttctttgagccctaacaagagcaactagtgagaaacatacacaacgaaatgcctgatttctcttcttctggtctccgagtgacaccctgttctccatcttgatggcttgtaatcatttcctgtactgcttaaattcactctcttgagcccacagctgaccacattctacaaatgatgcctttccactcacgtttggcaatgtgggctgactttgtgcagctgggctttgatcttgcttcttggaacgcattgctctttcccttgcaactgagagctatcattatacagtttactaaaatttcattattcaacagagttaaatagagttagcttggagaacatttggtaacactgccctgctgaccgcagattatgtttgccctccaataatctactgattattgatctcaggacaaaatctacaccccatgattctctcctattttagtttaattctaggctcctgcagctttttttcccagccatgcacccacctgactaaaaatctcattttcaagaccaattatcagccactgtaatcctttttactgttttccttgaaggctcatgagacgctcatataaatggaacttgtaactgccaggaccaataatattttggcatgaaatctcccgatgttccttctagttttcaaataataccatattgggaaaaattgaatttcaacttgaaggctgaattctagttactttttaaacctagtccccaagcccttgacatgccactggacaatttagggtaggcctagatgcatccttttcaacttcctgattagaatcaaaacttcttaaagcctccatacccttaatcccatgatcattaccacagatagtgataaataataatgtttcagtgttaatgagggagtaaatagcatgttaatgatgtttgcagatggatctaaattagaataagttgttaacaccaatgaggccagaaaaaaaataaaagtcctaaagaagaagaagcatacgagaggaaaacaaaaattgaaaacaaactgaaattcaactgatatactgcattgaacaaagagttaattaaaaagaaccaactactgtcctagagacctaaagaaagaaagcaacagcaaaggatatctaaaaaggatcttctccatggctaggattaatttgcacttcgtgccaaagacgttcaggagtatctttggatctgtgatcagtattgcagcattgtgctggtaaagttttaactatcagatctctgaggaaaaaaaaaaagtacttgtgtgtgtgtttgtctgtgtatgtgtgtatatatttaattactataacatttactgacataaaggatctctagcacggtattttcaaataaggaatccacaatattctttactggaaattcggtaaagcttaattgattctcatagaatattttccctgatttttgcaaaattcttgtatccatagccaatttatgatgaacaagtgtagttccgacatgggtgttggttgatatttttatttacattgaatatgctaaagtaaaacaacaaaaacacatgttagaacttcttttgttgtcaatgactgagtaacttctttgctgaattagataataggttttgaatagtcaaacaatatttcctgaattttttgtgctattcacaatgtaatggttacagacatgatagaatgttaagtttaatctctattattattaacattttctctatgtctttcttaagcctagacaataaaaaaaacagtcaagccttgatttgcagcatttgctgattttcatggtgtaaatatgctcgccatggtcaattttaggctacaaacacagagttcagaagggggcacagtagcaaaccattgtacagtgttttcaccatatagagaaaatgaacagaaattaccttaagagctcagataatagtaaaataatttgaaagtaatggcttttgagtattcattgccttttaagctataacttatttaatcaaaagtttatataactcaacttttattagtggttgtatttagtaattggctcatataatttctgaaaatttagcaataagctctgacgagtgggtagaagctgactccagcacatcactatcagtgacttaacctgagattcatgcctattttccagtttacaccagacatctcgaggtttcacaaattccacatgttcaaaaccaaactcatatactctctcccaactatgactgtaattacctcacagggtctcctggcccgttgcacagaaaaagccaacttactgagactgtgctattgcagtagagaaggagttttattagcataagtctagccacatggcaggtagagttattactcaaatcagtttcgccaaaggtgaaggttaggatttctcaaggatagtttggtgggcagggggctagggaacaggagtgttattgggaatgaaatcataggtgtgtggaaaatggttcttgtgcactgagtcagtctctgggtgcctgtggggccacaggacctgttgagtcacaaattgcaggtccaggtggagtcagctggtcatcagaaatgcaaagtctgaaaagacatctcaaaaggtcaatcttgggttctaaaatagtgatgttatctataaaagtaattgggaaagttacaaatcttatgacctacagaacaatggctggttatcgtttaaccacgcctacatcttagcaaaattcatgcccctctcataactctaaactggtggcctttcattaattttacaaaggcagtttagtttggggaagggctattatcaaccttactttaaggagtttaagattaaactataaattaaatttctcccagagtaagcttggcccacacccaggaatgaccaaggacagtttggaggttagaagcaagatagagtcaactatgtcaggtttctcctactgtcataattttgcaaaggctgttttatgactattattttatcttttacccaaccacagatactagaaacaccaaagtcatttaagactccctcttcctcagttctaaaaaccaccaatcaatcaccaatctatttaggtggcttctgaaatagttcttgaatttttttacccctattgaatgcagacatcatcaaatctagtctgcattatgactggatgaacccttccttcataaacctcccatgtcactctagaatggtgttgaccttgtacttggccttcttaaaaactagatacagatcaccacacctatcaggtggaaacccgaagaccctgccatggcagacaggcgagagtattttccagtctttcttgattgtttcctgctgtcttcgacttcacgccatattcttaccagtcctccgaaccacagatggcatactttgtaagtagcactgtgttcaagcagttctctctgccctgtatcttctccccattcttctccatcagaggaaattgcctacgtctcgcaaggaacaaagcttgtgtaaacttttacctgcttttctgtttttttttcctatatttttatttttactccattgttatcagcatgcatttacctgcttttctgaaaaagagttacatatttctttctctggacctcaattaccactttttcacatttttcttaaattaaataacatatacaatgccccttacacaaggcatagaatttagtaaatattcaattggtggtctcctcccgaatttcctagtaacaagggtatagacgttctcactcagaggtgggaattgaacaatgagaacacatggacacaggaaggggaacatcacatactggggactactgtggggtcgggggagtggggagggatagcattaggagatatacctaatgctaaatgaccagttaatgggtgcagcacaccaacatggcacatgtatacatatgtaacaaacctgcatgttgtgcatatgtaccctagaacttaaagtataataataataaataaataaataaataaataaataaaagaatccaggtgctagtgacttgcttgctctgtgatcttgggcaaattatgcattctctttacattttagtttcttcatctgaaaaaatgcagataatgatgcctgccttttagagttgctgggaagaccagacattgttggtaaagcatcatgtcccttttaggtgcccagtgtgttcacacatgccaattgcagcaccaggttttgacctgcacttctatgaatcagggattcccacaaccccctcctacggctcaattaatttgctagggtggctcacagaactcagggaaacactctcttaatgtttacttatttattataaaggacattacagaggatgtagatgaacagaccagattgatagagcaagatgtggggtgggggttacacagcctccctgctctctctgggcaccttactctccaggcactgccatgtgttcagcaacccagaagctcattaaatcttgtggttcaagagtttttatagagcttaatccacagcccccacccaccttttcctggagcttggtgggtggggctgaaagtttcaaccctctaatccacttgttcttcctagagactggccccattttaaggctatcttagggccccatcctgtcacttctttagcataaaatcaggtgttatcacaggggctcattatgaataacaaaaggcactctctgatccttcaggataatccaagggttttaggagttccgtgacaggagccaggaaaaaaatcaaagatatttcatgttctactacagtgggtgatcattcaacctgcatttgctggaaacttgttataagaggtgtaggtagaagagagagagagacagctatccttgttctcaaggagctcatggtcagatgtcagatgaacaaggacagtcacctgacagatgctaaaacaacaggattaggagcagtttatcaggcacctggcacactggcaaggtgttagaggtggcttcccagaggaggtgaggtctgaataggatggtattgagccatgaggcagagttagtccagcttatttgactggaaggaaggtcctacaggcagaggtggactggataactgagaaaagggaagttatacagacatctttatttctgcaagaagtttgagccattaaagaattttagagaggggttggggaggattatgatcagaacaaaattttagagacctctccctagctgctgtgtatggtccatcaattatagaaagagactagaagtgggaagatcagttttttttttatcttgaagatgtttgcagggcagtcagataggcagtatgttattttgtgttgctgctatagcaaaatactccaaatttaatggcttaaaacagcagacacttactatcttatatttccattggtcagaagtctcgtatgggtctggctggagtataactaaaatattgataggcctgtgtttcttttcggaggttttaggggagaatcacctttgttgcttgttcaagtgttgccaggattcagttccttgctgtttcaagactgaggcttctgtttcatttgccagttggcagctgggcccagcatcagctgcaggcctctctcctgtcctgtccgtgctatggacttccgtatcacggggcagtaaagagcatggactccttctcatcatgacctctctctgactcaggaaagcctctgtgattttgaggattcatgcgattacattgggactacctaaatgatctaggataatctccccattccaaggtccatactcctaatcacagctgcaaagtctgttttgccaggtgaggtaccacatgcacaggttccggggatcagggcacagatgcctctgagaggccattgttctgctgatcatggatgggggccttcttcttcctcctcctggttgaccctccctgactgtaactccattctgtctcttactgcctatgccttgtattgctctctaaatccctgacatgaaaagagtgattacaaatgtggactccacaccagatctggagaataaaaatctgcttttttttttttttagacgaagtctcactgtgtcacccaggctggagtgcggtggcactatctcggctcactgcaagttctgcctcctgggttcatgccattctcctgcctcagcctcccgagtagctgggactacaggcgcccgccaccacgccgggctaattttttgtatttttttgtagagactgggtttcaccatgttagtctggatggtctcaatctcctgacctcgtgatccgcccgcctcggcctcccaaagtgctgggattacaggcttgagccaccgtgcctggccaaaaatctgctttttataaggttttcaggttatttctatgaaagagcttgagaagtactgctctaaataactcgcaaattcacatctctctcagtacttagaacatgccaattcttgttgtcttgttgaattgagttgttgaggcgggttttgatcaagtaattcccctgtgctgggcaccacattttctttttgtcttctgatcactcctagcaacagatgtcactccttgggcctatgtctatgtctgtatttctagggtgacaaattctccaaggtcaggatgtcacagccagcaaggggtagacggtgcagagaatactggggttgagagacaccagggaagtgctttcaaatggcacagtctgttcgcgtcactgtgctgatgtggcagggaagagctgggaacgggggatttgtgaatccaagctgttaactgggtttcatggggagttgtcaaagcctgagaactggcttcgtctcaaagcctgcgggattagatggattcctaaatgcacagggccagattgacttgtgggaggtttgtgtgtaaagcaaactttgctttaggacagtgattttcagtttatttttgtcaactctctacctgaaaaccaggatttatgtctatagctgacaacagcccactaggtctcggtctgatacatgatgggagaatgactgaaagcaaggcgaggctgtggcgtgggttattttcccctaggaatcccctaacacacttctgcaaatctcagaatagcgtattggaatttttgacaacctggggcataattcaaaaaagccagtaaggtgattttggtaaatctcagaaagggtcatgctggccaaggatgaaaaccacgtatatacatgttttagggtaagaagttccatggtaaaccatggaggcttttttagggtctctcgccccatgattcagcatactcacattctgacgtgctcgttccagcgcccatgcccagagcaaggaccagagtgctttatatagagtaggctgtaggtaagtaactgttgaaaggaaaaatgcaggaatgactgtaaacgcttgtatttcttctgtcttaaacctgcctggctctaagcacacacacatatggaagtagcctcagggagtaagaggagagggaacattccctcttgctttttgctctttggctggagaggcagctcctccagggactgcagtgctcctgtgctgggtcccacagctccagggctctccgccttctctccagcagcatgtcctctggcagccaattggactgggtgcaaggaactttatcagctttcctttcacatcctgacagccacaatcactcttgtcggttttaattaaaatgtttaattaagcacagttctaggagcataaagttagctttcatcctggataagaccccaggcttggagttaaggaggacaaagagagggaaagacatgcaggctaaaacttcccagttttctatcagctgaagcgaacctcatgatgaagggagaagagccattcagttgtccttcacttgagacttgctttaggccaaaccaggaaggagtaaattgtgacttaaatcctgttctatttcttttttttgtttgtttttatatatttatttatttatttattttttattattatactttaagttttagggtacatgtgcacaatgtgcaggttagttacatatgtatacatgtgccatgctggtgtgctgcacccactaactcgtcatctagcattaggtacatctcccaatgctatccctccccctcccccctaccccacaacaggccccagagtgtgatattccccttcctgtgtccatgtgatctcattgttcaattcccacctatgagtgagaatatgctaattttaacaactcctacccctcggtctcccggcttctccaaagtctccagagcccctacaacatctgatcagttctgcagaatgctccatgctctctcatttcccctgtgatcactgccctccacatccccaccatccccttaaaacttacagtcccgtgtcctggtcttgcaggctctggcttcctgcagaagttctatgggtcagctgcactcatcaacctgtgtgatggtgcttctcatttgggccttgatttcacagaaatgtaagtcctcccaaagaagacttgtggattcttcagggtgaaggaagatattttaagcatctaagggagatattttctgtgaaaaacagtcttttcacaatcttcaatttggtcaaatttgctaattttagaatagtgtgtcctgtacataacagtcactcaaaaaagagacttctcagactctctcttccccttccaggcacactttcttggctacttgattccaatctcatttaccactttccttttcaaaatcagggctaaagcagtgacaaactacaaacaacagactacagtggaaaagtttattggcgtgtatgaagagaggataggggcatacgtgtactatttttcatctgtatcagctgagttggtggtaatgcgacaagttctcattcatagaaaatacatctcaaaaaacccctcagatggtagggttctactctctgatgaatagctatcatgaggttgatgatgaggactaaggtgctgttggatatccatctgcatccacctctaaagtgctctgcacccaggaaactgacctttgtgaaccgtgcccatgccacatgctctctgaccctctggtttccagttggtttgacccatagacatcagtgacagacatttagagggagaaggtgaggtctgggtattgattctcttgttcccctagtctggcctcactgtgggacagctgtgctcctcaattaaagatcacagcccctcctaggtgggcctctccaattgttcttttcaggtcactgttctcatgattattcctacttcaggcctagtatgatgaaagtgctttggagttactagttccagagactgcattcatcacaccttgggatttgcttgtattctgcccttgcttttgcagagtgttgcattctcctcaaattagaccgtttgaatgtgccacgtgtttcctcttggaactctgattaccaccatggtaaatggatagacagatctggagggggtggcaaataagtagctgcctccatgacattcagggcaagaggtgataaatgtttcctgattgtcaacgtgtggggggaagccacttcccttccctaatttttatcttacatgcaaatccatgatgttcagtcaaagacaataaacagaaaaactttctcatgaagtggaggaaggctcttaggtgatcttccaccacaagcagcttagctgcatagaaaaacctgggactcggaggtttcgagctacaccctgggcttcactggctgagcctggcacttgctcattgataaatgggatgaggatatttggccacccctcctctcatgtgtgttgtgagaggaacatggaataatgcctgggagcacttgaagctgcagctgagaaagccatgaagactgcttctaagactgtgaggtgacaggacccagaattgaggaactgtgtgagggccactgtaaatgagcttgccccagagttagggctggccaggcctgggactgcatttcttcccaagggttcctttcccatgacctctggcctgaccttcctccctgggcctggccctcttctgttaggggaaggcatttcagagccacgctggcatgcttgatcatgttttcaaaggaaaggaggagtgggtgtgaatattgctccaaaaactcagatgtggaaaaagtgtgacatccacttaagaaaaattaaatcgtattaaatccaagtttaagcctgtacccccctgagctctctcatgtgtacttcccagtgggtaccaccgaggcacccattattcatgccctctttagtccttgaagttgagggaccctattggttccatgtgaactgggggaactgaagtctttgtctaggtcccagcatcaccttgacctccctggtcttcatttgttgttcctctaatatctgtctaattcctcagggtcctgtgaggggacacatgccagccacaggtctaaccaagggagatcaaaatgcgaagatgcttgaggaagcaatgggaggtattgggtaacttttgggcaccatgcctgatttttcagtctaggtcattggaatgggtggtcccatggtctctaagagttaaatgaggctcttctcagttaccttttcacaggcccaagaaagcctttctcttgcagcagaaggagaagaatcagaatgtacaacatgtcgtcaagtgatgccgttctgctttagaggtttattttaaatatatttctttaaagcccattttggagacttgctactgcttgctttgtctcccagcaacgtcaaaagagctgatgggaaagagaggtctttttttttttttttttttttttttttttttttttttttactttttttcttaacgtgtgctttcactcaaagaaaaaaaaaagcaacaaaaaccccacaacttctaaaccagttcctgaaatagacccagagagaaaaggaaaccatagcatgctatgcagcctttctcgagggagcaattataacctagagaaaaagactcagctagtgcatggctcctggaaacggggctgagtgcaaaggcatcttcccctcctgcctcccaacaaccacagatgtagtcatagccagagctgggttcacccaaaaataagtgtaccaagaccttatggagatgggagtattagggtcgtcagatgaatttggacaaccatcagcccaggccacttggagataggagtggaatcttgatgccaaccaacacctatttttctaacattcaccctataaagcactgacagtctatgctgcaagcactgtgctgggcgctggtggggtagctggaaatataaccagtgctccagtgtcagctgtcaccactcacttatatgccgtagctatgccctagtcacatgaggctcctccagctttcagagctcaattgccctcatttgatccttcaggctttgcatatgttgtcctgtcaatcagcttcttcctgactgccttcttcaccttctagcacgtccttcctctgcttgttccctgacccacctctgcagatagctatgtgacccgcctgtgtgttctcagagcagcagtgcttctccttatgaagagactgcatcacacaatatggagtattctgtttgtctctctccccgactggactgcaggatccataagaacaaagatgttcttcatttctttacctgtgttctgtggtacctagcatggtgcatagtgcttaggaggtgattatcacttgattactgtttgattaagaagttaactccagaaatgaaatttcttattctgaataggttatggagacatcagacctactagtatctatgagactttggtccaaatctcagtttcatcagctatgaattgggaatagtcacagctgttacggttggtagaaaactctctggataaaatgtatataagacccctggcatctggaacagagcaggagctcagcggtagtgattagagctagtgtaaaagaacatttgtcgatgatgcttaaattcccactgggagactagatgcttttagcttccatttatggagtaaatattctcattggcaatactagcctttttacacctcaccttaaagctttttctaaattttcctctaaccacattattacttcctctgtcaagttttctaaactcaccacttagctgccagagagccctggagtgagaattgggaacagtactttggtgacgtaagttcacagctcaggctctggagtcgcgctgtctgaagatgagttctggcaagctgtcatctttctctgtgccccagtttcctcatctgcgaagtgggtatcatgacgcgttggttggttcctctggggagagatgcctgctctagagggttaccacctccttccttccacagcccacgctcgtccccctcacagctgcctgttctttgctcaggaatgcacgagggactgcttctgtcttccaggtgtccagagacacccaggaagtctggcatctaagtttagtgaaaaccaaggcatcagcagaggatggacaatggctggcagagatataacagagcttattcaattgtaagagagacgattgaactaaagtgtctaatccccagactctattattacagcaggtctttgaatcgcattgtctcattccatgtcttttcattataacaatgatgagaaaaagattgcttcctggaagggccactgtctgtgtggtgtttgcacattctcctggtgttggtggggttttctcagggtcttttggtttcctcccacatcctacagctgtgcatattaggtggataggcatgtgtacaaggccccagtctgagtgagtgtgggggtgagtgtgagcagccctgcctctgggtggtgtcgtgtccaggactgactcccacctggcgccctgagctgctgggagatgctccagccacctgtgaccctgaactagaataactgggttggaaaatgaatgaatgtatacaaattactgtcaaataaaatgttgtaaagtctaaagtaatcatccaaatgcatgacaataaaccatgaggtatgaaagtgctcagcaagcccgccatctttctaatagtttgttttagaacttggtggtagtaggagatgccctaacaattttcactgcagaaacgtttattccttgatttaattcaccaccattgtgaccactgtcactcactgattcaccaaagactgggtaaatattatcttactgtttttattaatctttcttaaatgtatatgctcacacgcatctcaaagtttaatagtagaactgttttggatctttatttggaagtttggtgattttttttttgtgaccagcaacatgcggttgaaatttacctcttatttatatcatttagcctatggtaaaattggttttgttatacatcgtttcacttaaagtcacggctttcaagaacctattgatgatgttaagagagggcttactgcacattctaggacggcaaattgctaagcaaacagtggatgtacagctcccagaagtgcggcccagaataacatgacttcagatgtaggggagagcttggagtttatctagtccagtggttcttagctgagggtgatttagaattaccagggacctgactcccttgagaatcctggtgcaggaggtctggggaaaggataaagcatgggtatttttaaaaatgcatcaggcaattctgtcagatactttctgacctagtccactctcctcctctctgaccacagtctctgacctgtcagcctcctttctctagggagcaattataacccagagaaaaataagctgaaagcaggagacttccagaaacatgtctgggcacaggtgccacccacgtgtgggtttgcattgggtggcaacccatcttttgcagcagggagctcaccagctgtgaattcttctgcttgatggtagtggagtggatgtggatcccatctctccaccctgctggggagactggaagggagcagccttctagaaactccaccactgcatgccgggataagtttccataatgaagctctctcaagcacaaaatgtgcatctaatggaatgccatttatcagggcagcaattcacatgtacgcacaaaacctttactttattgctttatatcatgaattacaactatatctaaagattgaagactctagttaaccctctaatcctaactccagggattaatattgggcattaattctaactctgtcttctgatactaattctagctgttgattccttgagtgctaataggaaatgccagaatttattctatggattattctcagttttagccccatcattccaagacatgtttggattattttgaagtggtcatgtggatgggtttaacctcagacctagaggggagaaatatactgcttagcagttcaaaggcgaataaaggttggcaagattaatcacagtgtggattctgtactatttcaaaactgaataggaggtttgggaaattgtggctggaaaaccagactttccaggttgtcttccatcaagtgatcactgatgtatttatttctctgattaatgaactttgcaaattaacctccacactactctgtaattgcgattaaggtttcaaaaaatcacttaagcgtgtgtttccaccactcctgagtccattccagccggatggcctgctcactgtgctgatttcacaaagatagtgccagtcccctgacctctgaatttacaattattgcattcagcacccaaattacccccagtctccatgtgcctggctttatctctctgcacacacaggcctggcttttaattaaaggccctcaaattaaatgaaaacaaattcaattattacatctcattggagcagctcacagcatatcctgacagcatttatccaatgggcaacccagggaaagctcggctcctacaacttaagttaatgtgcccagtaaatgatttttcttatcattgcttgaacagactttttgccactgggtcagccctagctgtggtctttgctgtctctgaaaaaaactacagcttaacacagtttctcttttctctatcttttctggtctctgcctggttcttattctccctttctgcatggaaggagaatggtctcatggtctgttcccactgaggatggaagataattaccctccaatctctgcaggtttggaggtgcagctcagatatgcaccccttaaatttagatccttatccaaagctcttagggctatccaggggactgtgtgtatgttcttgactctccaagctgcccgaagtttagagaaatgtgcactgaattgcgattattgttatgatagatcataacaataatcataataatagtatgtttattgaggactgtaatgtgctaggcagtgcaaacagcatgcaattagacacagtccgtacccagtggaccgactgattacacaagtggaagcaaggcaagacccagacaaaaggagcaatagaaacaaactgaagggagagctgggaagggagaaaacaatttcttttttgataagtggccagcggaggtcatgcctctaccttgcctggactgcactttctgccaagttttgttttgagtatgaaactctttaactaagtggcagattgggcctagatttggagggcttgtaagaagaagagcattaggttcagaggcaggaaacaatcactgcttcagggatgggcataatctgatcaggaaggctcagaagattttttgtagaagggtacatatcagatgctgttgtccctgtcagtggcccaaggcaggaatatgggaagcctcaaagctctgcttcccccagcgctagagccagatcacgcaaaagaaacaacacagttcaggagagaggctgaaggaagagctcagcagatttgcatgaagacagggaatccctgggtcttctatccgagggtatcctttttctgatggtggctggatttgtgtcccttgttgaaaaggaagacccaaatgcagatggcaacagaaattaaacatacagatcacaaaaactcccaaatctacttgtaacccattcagcagggaaaagcaaagcaggagaaagaagtgtgggcattcgagaaggagctgcaattccaaatctgtggccgcaagacacagtctgcctggcattttatgtgcccccagattcagcccagacgccctgtcaaaatgagtttgctggagaactctggcagaggggacactgtgagcttctgctcaacgcccacaggtctccctaggttctcctgggggtggtgaccagccaggggagccaaggatttgggggacaacaaggtttgctctatcatttttacatccttgcttgagcaagcgtccttaataatcccttttactgagtgtcctatgtatagggagaactgtaaaagcctgttttgaatgaatacaaaagaaacggaagatctcaaggtatttataatctaatttggagggtggaaaatacacagacataatgaaactctaaaatgtcaagttccattttcctgctatgattcccataatttctacatatgtttatgatacgttttaagacattgcattgatattatctgtttgtattttattattctgctctagactaaacttcatcaaagcagggcctgtgcctttgtttttattttttaaattgtgtatcttcaaaaattagtactgcctctggtatctggcaatatttgtttacctttgaattgaataaaataaaagcctaattctaatgtccctagctaaagctgcatcagcctcctctggtctcccgtgatacttggtttatgcttctcttatcgttactactcaatcgacctcttctctacaagctctaagaggcagtgtggcgtagtggttaagaggctggctatgtaaccttgggaaagttgctttatctctttagccttccctgtctgtggaatgagtaggaggataatttgcttactttttgggattgtcatgaggattagacggataacacatgaggtggaggcatgcctggcacacggtgttatgtaaagggcaccttttcccattatcaccatcctgaagagttctagcataggttgaattgtgtcacacaaaaagataggtacaagttctactcctcgcgcctgcgaatgtgaccttatttggaaataaaatcttgggagaggtaatcaagttaagatgagaccataccttattagggaggacccttatccagtggccagttttcttacatgaagagggaaatgtggacacaaaggtacacttagaggagaggatgtgaagacacagccaatacagggagggcgtcgtgtgaagactgaggccggattggagccatgtgtctgcaagccaccagaagcacagagcagagccgcagagcacaggttctccctccgggcctctagggggagccaactctgcaaacaactgggcttcgaacttccagcctccagaactgtgagagaataaatgtctatggttcaaagcaacactacttatggtaatttgcagactaagttttatcttttgtgtatacatctaacacaacacctaggagagtgcttggaaggtagtagatcttggccaacatacacttgttgaattggatggattcagccatgagatcattaatgtgaatacacaattataaaatagttttcatggaagtagaatttgtctgttctatgtaccacctatttgaaattaaataaaaggacatatttatccaattcaacttgccaatttcctttcaattttgatataacatgtaattggtacgataacattgtatatcaaattaccctgaacaatgcagtaaatggaaaggaggtcgccataaaagggtaatctcctaagaggttaccatgagacagagtaacctgcctttggttcattctgtccaatttagcctactccctcagctgatcccttcccaagaccctggagttccttaaataatatttgataactcaaagtagaaaaaaattaaactaagcaaacaaatcaaggtatggtatgtatatatttatataggattgtgttggtcttgaacagacgtttactcataaacatttatcaaatggcctgttgtgtaccaagtactatactaggaaggggatgcaatggtaaataagacaatgagtaagatcaatgagtaacattttatgaagtctttgttatgtgccagtcaatatattaagtatactattttatttgacccttacaataattgagttaggtaagtccatgtcactaatgataagacaggcttagtgagatttacacattgcctaaggtcacacagtaagtggtagagacccagatttgtacttaagtaatctaattccagagctctttaatcactgcacaaaaatttggcatctcttatcctcatagagcctagagtgtagtggtaaagaaggcaagccagcaattgccatatagtcacagaaagaacatggttaagaagacttccagtaggaatcctaatttaagattttcctggattcatattccagaccagtttgggcagaagttagaggagaaaatcagcacttgggctgatttatcattacatctcctaccttggtttggccttggcgacttgggtccagtggcttagaggtgctttcatggcttagagtttctgcagatgcgggcagggcagaaaccatacggtcagtctagtcagcagttttcagttatgagtcaaagaaggagcagaagcctgagctgtgtggggacaacctcttccagctcatcctaggttctggctgctttctgtcttggtctggccatattgttcgacccaggagattgggtacttttataactccaggaaaggtacatgtttatgataaatgggaaaatatttcttggtcctttcaaagagatgctgatccaaggtgagaaactgtgtgattatgagagactgatcatcctgatcatctatatggtacagctagctgccttgcttctctagatttctctagaaatctaggttgttaaaatccttgtaatgcactgtgctatggcttgaatgtcttccccaaagtttatgttttggaaactaaatccccgatgcaacaatgttgagaggtaggacctttaagagttgacttggtcatgatggccctgccttcatgaatgaactcatattgttatcttgggtgggcttgttattgccagaagggtttttttttataaaatcaggttcaggaaactcttgctttcactatcccccaccctgtgatgccttccagcatgggacaatgcagacagaagaccctcaccaaatgcatgcccccaaccttggacttccagcctccaggatagttagaaataaatatctgttctttataaattacccagccccagatattctgttgcagcagcacaaaatggactaagatacactgtctaagaaatctttttatatcttcatggagactatgcagtttgacttgctcgcggcccagttgattttcaagattgacaatcagcactaactctattatagaatttgcctggctgctgcactgagaactcactgctgtgagtattgtctccagcttcagtggacttcccagaggttgcctttgaaaattttacactcaaccatttccccactcactgaaagcttaaaagagaacaagtctaaaagagaatggttatttttagtaggaagttagttgtgagattttgagtgggagagtcagcctcagagaaactagacatcttctcagctattcttgagtccttttttgtcttgttttgttttgtttggagtgaatttcccaaacctctgtcatattaaaaccaatcccatcaatatcccatttgcaacttatgtaaagaatattattaataataatatcaatatcaacatagcatttagaaatagaagatgtggtatgagacccagctctgccactttcagactgcagctctaggaaaaatgcaaaccctcaatgcctcagtttcctccattataaaaggaaaattataataataatattagttcatttcacaggccttttagaaaagtcaaatgagataatgcatgcaagagtgttttgcaaattgtaaaatattgtacaaagctttgttatttttacagaaaatacatatggattttctgcccttttgaattattcattttctatctctttatagtggtctgaataattggatatttgattcttatcttactttcttggaactctgtatatttcacatcaattatttcattttactctcacactacgtctgtcttacctacaaagagcagagtgtgattgagttgtctaatatttaaaataagttggactccaacttttggtcctcttggtatttatttttcagtgacttttctgctctaaacttggggaaattgctgctatgtagactcggattattacttggagaaaactaaacttatgagataaccttttctccatattctgacgcttgttaacaggaaagccattgggtggtagcaggaaaagggttgcagtgtcccacaagggcactggtttattttttctttgattgcatggcatttttggagcataggactagctagcatacaggtccagcagctttctcaggaacctactaccttaggatcccaacttgagtcatggcatctgaaaccaggtaccctgagctaggctgtatcatgatccagaggccatatcacttaagaggaagagcattgaacagagaattggagactgctcctagctggattgtttggcttgagaatatcacttccctttagaatattgcctatctacatttacattttttaattttaaatttattattgtggtaacataacataaagtttgccattttagctcagtggcattaagaaaattctcattgtacaaccattatcaccatctacctccagaactgcaaagcgttgtttttagagtacaaatgaaatcatttctgggaaagctcttagaagagcataacacaccataggaatgcaaaatattgtcctgactcttattgcccaataatttagcggaaggagcaaagagcaccttaaaagggttgcttaacttataagtgctttgaggaggctgagtaaactatctccctgaaataattcaaattagtggggatgcccgttggtcaggatcaagtggacacgatttattgctaagggaaagttgtggattacctgtaacatttgaagttgtgtccaacttgaacattctacaaatttgcatcaataacttcctcacttgaggctaaattagaagacattatttccctcctgctgggcatttggaacttctgggtcggaaaagctgaagcagtaatgggcaggagcccaagctgcctaatgaataggtctaaaaatagttgagagaatgaattctaaagtgcagagttgtgatgttcttatggaagacaggtggccctcttactttaaccaaaccaagttttccaccctaagttcactggaaggttagtctagcttgccgaatacaatatgcaacagacgtgtgcatgcattagtagatagatgcataaaagcaattcattcatatatattttatatatatataatatatatatatatgcttccttaatctgttaaatttaggaaaactggattaaagggaagacacatctagaaatgacatgctgcttaaggaagtagaaatctggtagcatgaggctgtgtctgggaatgctctgcatgggttattttgggaactgctgttctcttgagaaattaaatttgtagggagaataggactaatggccatttgtatccagctgcttgcatcctttcttcagccagaggagtggatagagggggtatgtgtgtttgtgttgttcgctgaatgcccactgtcctgaggattcacagacaggctgtgccatggcaatgaggttggtctgcaactgcactgtgagagggtggcaggaaaaggcactgatgatggtgatgaggaggctggcggctggcattcatcaagagcttgctgtagatccagcactgtgttagacatgttagctgtttttttgccatccagtgattaagttcactgatgcttaaagaggttaagcaaactgcccaaggtcatacacttagtaaagagcagtgctgagctcaaacccaggcccatcttattcctaagcccaaaagccaccacgcgtcatcaatagagatggcaggcctgagctagtccctgccaaaaaaattcacaagttaaaaatagaggatatttttccttttgtccttttttcctttatatcatagttactttcctgattctttctttgctgggggagggggaatttaaaaaatcatacctaacatttatttcagataagaaagggaagcaagtaacaaataattatgtgatgaataccaagattcccaattttgtgttaagaactatttcaacagttgtagtaccaggtatatccctgtccccagggatctggcatgtttttgttttgttttgtttctgcagatatcttgcagaatggatgtaaatctatgttctttgggatttttagaacagtgattcccaactcacatgagagaaatagggctaatagaaaattaggtttggtgaggcatgggaccctggccgggagatgaaaaagcattggttggtgtttgcattttttgttattggaattgggtgaaggaggcctggttgagaaatattaggggaggacttgagtttcttacccttcatggtccctatagacttaagaatgcaataacaaagatatttaggtcattttaaacttattttgaaaattgcatatttcttgtttgcatctctttagatttttttttttaaaaaaagatatttgtagtcttatccttcgccttgaatagagagaaggaatttatggaggtgcaatattagcgaaaagtctttacattttctcctggaggaacagagaagacgcatctcattcattcagcaaatattaactgggtccctgctgtgagccagacttttgtagtaggcccagagtataaagaagacagatatcctgactgcctgggaggagtgtacagtgtagtgatgccttgagagatggctctgtcctgagcagacaggaaatggctacgctgggacataacaaaggagctgatttccaaaaggaccacattgggcagtcccaggacagctgagagactccatcaaagctgaagatcagagacgaggcttgaaaacatcactgaaataaatcttaattgccatgagggaggtctgaattttgtggtggccaatataattcatgagatgtctatgtttgcaaggttcgatcccccaggtcagcaggtgagcctccctttgttccagtggcagctgatggggtgtctccttgcagacaggtttctgctggagcttgcccttggcgacaagagggactaggtgagagcataggtttggataaacttaaatccatcattgtcactagaaaacatttcagaaaacatgccatattaatgatgggtaaatggcatcatcttctgtgaagaaatgccttcaccaaatcaggatttaatgtaatgcctctaccttttcaaaggatcaatatgagacctggcaattgaacagcatttctgtatcctttataaaaatggggttgaaggtatttttctactatatgactcaaagccctttttataaattctgtcaattgcaaccccacactatctctcacagtaagtttctgcttaagtttggttccaaggaaaatgctgtctcggctgatgaatttgtgtgctttctgttttcagagaacaaatggcataagccaatgtcctttccatttgccttagctggcactaactcagatccaaatgcatcgcccaaatgttatctgctcaactcaggtacctgggacattccctctctctgctttctccaggtgatctctgctttgacttatgcttaaagactttacaaagcaggactatctgaagtccgctcagtacataagctacaaatacaacagggatgattttttcctgtacatctatctgttcgtctctctatccaatgtaataaagtgaaacaaatccttctcggatgattgaagtatagagtggcatcttattggtgcttgagaataaaaaattatggataaatgaaacatttttgagtaccagtgactctatatccctaggtattgaagggaaacatagaaaaaggaagagacatagaccattctcttggaagatccagcccaactggggaagactgcctacatttttatcccctctccactcacattcacttggaaatgacccataaatattaaccagctgtttgaaaataagcacaagtaattgcaactcttcagttgccaggaaaatcatccagaatcaatgcttttctcaaaaaatagacatggagtgctactatgtgcacgttgttgaggagtgatgaacatgggtcacactcattttctgccttcaagacctggtagtctgaataggggccaaaccaatcctacatatttctatactacagctgaaagtaaatgcctcagtagaagtaggaataaatatttgatagtggcccagaagggtaagggatcactttttggatgggaaatcagaaaaggttttataaaggaggtgatattgggcagaggggcaatctaggttgagcacacaaagatacaaagaagagaaaatggtgggtgtgctcaaggatggtgaatgtgccatttgtcttgtatgtagtttacatgcaaaagagcagagaaagataagtgaaagttaagccagtattatcaccgcatcccttgaaaggcttgcactacttaatgttgtaatcaaaggaggactattaaaggtttttgagcagaagagtgatcactagactagtgattcagaaaaactgagttgagccttggggtaaataatcctaagagattgagagcctgtgtaaacatgataatagcaaagtggacaaatcgtgtcccttagccaggatttgctcataggaatgtggaaaaataagagtgagtgacaggaagtcctagctagagcaattagacaagagaaaaaaaataaagggcattcaaattggaaaggaaaaagtcaaattgatcttgtcttatatttggtaaaagctaaagactctgccaaaaaactattagaactaataagtaaatttacaaataatttatttgtataaataatttatttgcaggatacaaaatcagtatccccaaatcagtagcatttctctatgccaacaatgaacaatctgaaaaagaaaaaaaaaagtaatcctatttatagtagccacaaataaaattaaatacctaggaattaaccaaagaagtgaaagctctctactatgaaaagtataaaagctggcgaaagacattgaaaaggacacacagaaaatggaagcatattccatgttcataggctggaagaatcaatattgttaaaatgtccttactacctgaagcaatctatagattcaatgcaatctctatcaacataccaacgacgttctccacagaaatagcaaaaacaatcctaaaatttatatggaaccacaaaagacccagaatagccaaagctatcttgagcaaaaggaacaaaactggagggatcacacacctaacttcaaattgtactacagagctatagtcactgaaacaatgtggtactggcacaaaaacagatacatagaccaatggaacagaataaagaacccagaaacagattcatctacctacaatgaactcatttttgacaaaggtgacaagaatatacattggggaaaagatagtctcttcaataaattgtactgggaaaactggatatccatatgcagaagagtgaaactatctcttgccatatacaagaatcaaaatagattaaagacttaaatctaagacctcaaactatgaaaccactacaggaaaacattagggaaactttccaggacattggactgggcaaagatttcttcagtaataccccacaagtacaggcaaccaaagcaaaaatggacaaatgggatcacatgaagttaaaaagtttctgcaaagcaaaacaacaacaacagcaacagcaaaacaaaagcaatcaaaaaaagtagagataactcacaggacgggagaaaatatttgcaaactactctctgacaagggattagtaacccagtatataaggagctcaaacaactctataggaaaaattctaataatctgattaaaaagtgagcaaaagatctgcatagacatttctcaaaagaagacatacaaatggcaaacaggcatatgaaaaggtgctcaaccttaatgatcatcagagaaatgcaaatcaaaactacaatgatatatcatctcaccccagttaaaatggcttttacacaatagtcaggcaataacaaatgctggcaggatgtggaaaaaagggaacccttgtacactgtcagtgggaatgtaaattagtacaaccactgtggagaacagtttggaagttcctcagaaaactaaaagtagagctaccatgtgatctagcaatcccatttatgggtatatactccaaagaaaggaaatcggtacatcaaagagatgtctgcactctcatgtttgttgcagcactgttcacaatagtcaagatttggaagcaacctaagtgtccatcaacagatgaatgaagaaaatgtagtacatatacacaatgaagctgtcatttgcaatagcatggatggaactggaggtcattatattaagtggaacaagccaggcgcagaaagacagacttctcatgttctcatttatttgtaggataaaaattaaaacaattgaactaatggagcggagagcagaaggatggttactatagcatgggaagggtagtggggagatggaagggaagtggggatgtttagttgttacaaaatagttggaaagaatgaataagacctattatttgacagtacaacaaggtgactatagtcaaaaataatttaattatacattttcaaataaccaaaagagtataattggattatttgtaacacaaaggataaatgcttgagggaatggatacttcatttaccctgatgtgataattatacattgcctgtaccaaaatatctcatgtaacccatacatatatacccctactacagtaaaagttaaaaattaaaaattaaaaaaagaatgagagacgctgatgtgggagagtatttttgttaacataatttggcaactataatatgttggctctgagtttatgagcctgcgagaccagaagcccagtgatgccatctgaggcatgatgtggggtggaccaggaacagggtgtgttaagaaggattaagcatggggcagaggaaagtcaacaggacatgttgcatatgaggggctggtgagttgtactaagatgggggtacagtggagggcacactaaagtgtaggaaaggtgggggaatggtgaagagaggacttcctactcctcaggcctgggccacttggataggagtaaagtggaagagaggggattgcttcttaagcaggtgatccaagtccttcaagactcctgagccaggtgtcaggcaagaggacttgccaaagctgtagtcattggaatcttctgtattatccagcacaggagaaaatcttctagaacctgggttgttcttgggattagccagttatgttcagaagtaaaaataccctgaagatgatgaaggaaattggagaaacagctttcatgagactgcctgccccttctcctggatgagggatactggagacagccatcacagcagctaggatccacggagcttctcacccactgggtgccaagtgccatgctacacactttatctctggacagttacaaattgatgaggtagatactgtggtcaacatcattctataaaggagagtaatgaggcttacatggatgcctcaaggccatacagctaccaaagatggtaagctgtagccaggcattctctggggtgaaagccgacagtacagttgattctcataatctgtggtctataaggtcacctcaaacaccaagttagtgaacactgaagcattgttcctaaggcaaatacacagttaggttcctgtgagcttctgatcacaacatttttgtctaccaatcaatacataaccttgttttatgtgtatttccatttaaagacacctcatttaatatatgttgttgattgattaaattgaactcacacgcagtggcactgtaacttgtgcctgaatgtagcttctctaacacacatgttttctccataaggcacatcacacccttcttgtgcttttgaacactagagaggacttagatctatatgtaggggctgttttaaaccgtgaaatcatccacaaaaatgcaaaaaaaaaaaagtcactaaacagacagtgagaaggaagtgtttataatataagagctgaaacaagaaggcagggcattgccaccttcaacctcactgggacaatgagattgggatgactcaaatttttcaccagtctgcacatatccttgaattacctctaaggtgacataccatgaatattggttttggggttacaaataaattttggtgagcaggcaaattcatagacacagaatttgtgaaaaataagaatcaactgtacttcaggagccatgggcacattttgcaatgtatggactgctaagagaaacctgtaacgaatgatacatcttacttcctcttggttttctccccttaatcttggagtcagtctttcctgacttcccagtttaaagggcaactccttggagctaagtcacaagcctcagaatgagctgcagaacaagtgcacacagccctcagcagaagcatcaggctggggctcaggtccccctgaagcacacgtgtggaggacaggtgaccccatgtgccagaggaccagtcacctccgacaggatccagccttcttcttaggattctggccctttttcaccctttcctagcctctcctttgggcttaatgcagtgagggttagaacagttttcttagtgccaagattcttgctaatacggcagtttgtgatttttggcatgttgcaagatatggcagattaaggtgaagtttccaggatcagaaagatgcaagttcattagtggctcggatgcttctctcactgtgtgatcttatataaataccttaacctagtcaatcctcagattccttagctgtaaaatgagggtcatacttatatttacttcttagaattattgtgaagattaaattcgttaattcatgttaagtgcctagtacagtgcctgccatatggtaaacactcagtaagcattaactttaacaattttatatcttaatatttaattagtttgcatatcacatgcatattacaattatatgtaatttgaaaaaaatagtctttaattttttttcctatatacatcagtgattgattatggactttggcactgggttatcttaattctgctcttagcttctttttctatctgggtaactttgggcaaattactgaattttgaattactgaattactgaactttgaatcttagcttcttaatctggtaatgagagaaaaataaagcctaactctcagattgattggaatgttaaatgggataatgcacttaacggagctttagcgctaggtctgacacgtgataagcattgataagttcttgctgttattgtaatttttaatattattaataatcatatggtaacattgcttttctgagagtgccttgtaatgcattctgtagcttctaggcttatttttctgaccttcattaacaaactttctttcaacaaagtgcatgcttggaacgcgtcctgctttttgatggagggatatggtggctcagcagagcgctcagcggatgagagctaagactcagcagctaaaggatggttggaactgggggttggggagctctgctgaataaaggctttttgcttcctaatacttccacttctaatgtttctggagctcatggaggacagctactgacaaaaacctgtgtttatatatcatcggtctgcacgggttagtaagatgcccagagctgctgaaagacaaaccacaatgacaggagtccccaaagggacaggcggccctccccatgggcttggaggagcaatgccagtaggtcattctgcagctagaaatgtgtcttcaagggcacatctcactaggagggatggtttatctctgctgcctgtccatggatgctcagcagggccacgtgtatgccgtgtcttcgcattaaaccatccattgcaacatcgtcgacattcattccgcagcttgacctttctttccctttctctctcgcaaacttcttcttccgctgagtcgtgcaggtgggtaaatcttcctctgctgcatccgcatgctggggaaattggctacctctgctaagtgtgattggagccgtttgtttttaagctgcacataagcatcgggcaagatttataacaccttccttcttgccgaatcgacccactgggagccattgaagttttattgctccttgcagttgcctggccagagtggaatggaggggcctatagttggaaaagctttttcttccattgacttactcacaggaagtactggagagaaggaatagaagtgatgcttcttttgttcagtctcctcattttgatcccaacccttttccaaactgcattgagttgttagagtgacttcctccatataattcacattgcatgctaagccttcccactgtaccaagacctccctaaggccccacctcttccaggaagtcttcttgggttgatcaaattaagactgtttccctggtactccccttacctctcttggctggaccccaagacctttctcatttcagtggtctttgtcccagattttgacacctatttttcttcagacttgcagctaccttttttgttgttgtcgttgttgttgtttttgttgagatggagtcttgttctgtcacccgggctggagtgcagtggcgcgatctcggctcgctgcaagctccacctcccgggttcacgccattttcctgcctcagcctcccgagtagctgggactacaggcgcccgccaccacacccggctaattttttttttgtatttttagtagagacggggtttcagcgtattagccaggatggtctcgatctcctgacctcgtgatccgtccgcctcggcctcccaaaagtgccgggattacaggcgtgagccaccgcgttcggcctgtagctacctcttaacgttaggtaaacgtacagatgttccagtcataaattataaagttctagaatcctaaatctgggagaagtattagaaattctcaatgtaagcagtgacttacattatccacgttcacatagtgattgaggtatttttatgactgtcttaaaggaggagtcttcacaggagatgctctcatgccagattttaaaacagaaacatgctccagggatggcctcagctttctttcatgggggctttagctgaaataggtagacataggttggtttcccttggaaaaagacatccttcttcattgtcaattagtagtagttattattgtatatttacccatgtgctatgcaccatgaaagtccctgagacaacagagagatgggccctgcatctatgtatggagcctgaagtctagcacagaagaccatttcaaagaatgtcccctgaacagtatctggaatgagaagatggactggctttgtgattgtttattcaacttgaggtccaagcctcaagcaaaatctatcttcagtgcaataagatacaaagtatagtaataataatagtaataacaatgacaataataataattaccacctgtgaacatctattttattcaagtactgcactaaatacatagattatttcatttttattttaataaaaatctcacacgataggtttttagttgcatgttttctataaggaaacaagagctcaaagaggatgccttaaccggcgaggtcatccaatcagcaagtggctgagtcagcctgaaagccacactaaggccctacaggtaggactgtgtattctccctcctgtttctctgcaaacttgtcagccttgagaaggtttcaacaatcatctatctctcagtgtaattctgagttgctgtttcgtcttgcatacatatttgcattttaagaacgaaagatttagatgggttacaagattttatgatcaggtgtagacattttggcaggcatggacatcttgtatgaggtcaccccctaaagggcctccttagtaagctgttgtctctaacacactctggctttactggggattgttggtaagattacaaagtggttgagagccaagtactgaggttagagcttgagggctcaattcttgcctctgacactcaaaattagctgagtgactttaacctgtgtgcctcagtttcctcatctgcaacatggggatgggaaagaacctcatatatatgcttaatatgagggccaaatgaaaaccaatacatctgaaacactaatgaccatggcttgcacacatcttcaagaaaatttaatttgtaatatcttttttcaagtatccaaagtcattcacacataccatcacattcagcctcataacctgggttaaaagctatccttatatgataactcaattaaggtgatattctcagtcagagagtaagaatgacacatgttctggggcaatggaattcactgaaatgaacccatgcagagcagagcatttcagacaactcattatactctctctagaagaaacctacctcctggttcctatagttgcagtacgttcaacattcctggctgaacaccctttttgacgttgagattaagctgaagtgttacacctggttatgacacccatacccttgagagaagtgcttgcttttcttggtcacccaattgtccccatactgttcccacaaagtaagtcatccagagctcttgtagattgccataggccctccttcccctgacacatcccaaaggttagaaacaagagtagaggcccagctcattcctcaagggtccattcacttttacattttccaggtttacttatgagaccaaaatgaagcaagtgggagacattcaaagtacccaatagttacaccatgtgtgtctctgtgtgcttaccaaacccagctctttttagccattgttagcatatcatgattatagttattaatatgataatgatggttattattattagacattttctatgggccagccatggtcctaggcaggtggcttcatggtgcggagtctggcagcggccctctaagggaggaacatctgctttagagcttcccttaagactccgaataaaacccatgggcagactcaagggccccatacgatctgcccctccaaagctctctaacctcactcacccactctaacatggtgctggttcctgcctaagtgtctttgcacttggtatccctctccctggaaaaggttctgactgtcaaatgttgtacctccttaagagattcagttctctgccgaagtaaccttgagaggcaggtctgcccctccatatgttctgaattaatccctcctctgcatctttagttttattcacaacatctatcactgtgtcttctcttgtcaggtgtttgttttgtagtctgacttcttcagtcgaatcgcaagccatgtggacagagattttgcctgttttattcatcctgcatttttatctaaagaaatgcttggaatacagcgatcactgaatacatatttattgaaaaatacaaacactgagtgaaggaattaataaattaagcagatggtttagaggagtgaattaacttctcaagtttacacaaccggtgagtttgtcaggtaacttctcatagaagaactctggtagcaagggatgcagctttgcctgttggggcactgaaaggctgtctaatcttaggtgaaagcagtcaggtccagggagatctttgtgtgcacagaagtactcaagaagtcaggaccagaatgcaggccatgtaacaccccgccggtggctgcttcctccttttccttaaggaccttttgtgaagtggccaaataaatactggtcctgtcatgtcaagtgatgtcttgcctcttccttgtggctggaccacttaccggttaattggtggttcttgggcagaggagagtacaaaatgtgagataggcatcccccaagcagggccacattaagccctgagcctggatcctgcctcatatttaagtcaaaaatagtcctttgttaggaatagtctccaagttcctggccatgtgtttgaggaacatttgtacaggctatgatacagagagcccaggctgagggccaaaataccggagttgggggcagctgtctccctgactgacctatacaatgtgctgtcatcgtccttagtgcctgttttctcatttgagatggagggtgggcaggaccctctgcagcctccaagcattcactcagccctcacagataccctgagcattctgtctgccctcacggacacccctaagtgtcaccgtgctctgtccctgctgccgtgtggggctggactgccagttttcgctcccagtggccccagtgtggagtgaagcatggcccttctgtgaagggaccaggaaagacaaaaaggaaaggtggggtgcgtactaacaggtcattatttagatgtgatttgcttagcgcttttcctgacctagtgaattaaaagaggacatcgcagagggaaaacaaacagggagacttaaagtaatgctttttgaacctgccaattatcaagagagtgtaattatgggaaacacccaagaggtccagagggacccatgtctttgttctcagactgcagagacccactaagataagagagtaggaggggagcgcttgtgagacagaaaaaggaagtgccgttgttgggagctgggagctggccagtatgtcttctaatttaattacttatctttccctcaaattgtttatggtacactaggctattaaatgcgccataagcaaacggctcttgaaagaggaagtggatttatttgttttagttaccactccaacaaaagtctatttcttctgctaattaagattccattcactaatttaaatgttatgctaattaaagtataattctgaaaatgtaaaaaggagttaaaaataaaaagaaagaaaaaactgggttggcctttaggaattacattaaatttattgcgttgtaacaatggtaagctgggtaattatttcattcgcctccgtgctgcattcaagcttctgcttattcatcccattctcacacttcagctcattaacacacacttcccctctcccgctctaatgggagttttcttgtgatggtttaagatgagttgtgagttagatccttgaagcaatgtttagaatttcttcagctgggccacacagagtgttgcaagctgctgcttgatttgatgtttagagagaaaaaaagagaaaacatctggatttctgctttgtaaaccaatttctggagccaacttgctgttactccagcttcttctccatcctctctagaagcctgagtattttatagaagacagagattataatatgttacaagaaagaggatgagtcttcttgccaagttagaatctggcattttgagcatctgggataagacaaagggaaaccaggaccatggggaccaccgcagacattcattaccagggcctaatcatcgaagtttcagcttcctcatcagtcagatggcattgtcttgagtattagaggcacctgagctttgaaaacagctaggctggagactggaacagcgtggcaacctaagtgttcccgtcctccccacccctaattttgtggttgcagcaccaggctggaaaatggggccctggagtgtttttctcggcttgagctcttgtctgccggacgaccaagcctttgccttctatacaggcaaaacgcagagccacatacattagttattccttgctgtagaacaaattatcccaaactcagtgaactcaaacagcaaacacttactatctcacagtttctgtgggtcgggaatctgagagggtcttcgctgagtgttttcgggtcagagtctctcaggagacccagcagtcacagtgccagcagggattgcagccatctgaggatccaaacctgctcccaggccatcagccacagctccagccctcagcacacggcccctccacagcgcagcagcttccccagagccagtgctgcaacggatagagtgtggcatcactgcctcttaggacaagcctctgagccccccaccctcccttctgcattattctatccattacaggtcactaggtcctgcccacagccacaaggaggggttccacaagggtgtggcacccagaggcggagacctcggggccaccctgggatctggccggcctctgtgttggcctcccctccaacgcagtgctttgctttgtctcactgtcttctgatcaaagcctgaacctctggccttcctgcagctaccactcatgtccagccatctgcctatcatccagcctaggcattctgggacagatccaggaggtcacatgtccacttctgaggggctttggcgagggctatggcaagagcgggtggactgagaagtcccctcctgaaagacatgtctctattgaggctggtctccagccaggctctcagcctgtcagtggcaggatgctttggagaggcatttagaatgaggcacagaaggcactgggattttctttggggacaagcgacaagagctaggattgatagactgagatgataataaaaatgaattaacttgcatctcaatttgattttcagagccagagagaaggagtaaatcagcaccatggagctgactttctcatctggttgggttggccctttatttttattagggtctttcttgtcaacggttgaatgagatgttaatactatcaaccttaggccacagtctaagctaagtcttgacagttcttgcttttcctctgacctgtagcttggaagggagaggttgacaccaggccagagtggagggtgggaggtgataaatcagtcctgggtttctttttttctttttcttttcttttcttttcttttttttttttttttttgcacagtggcctttggctttggcagctgcattaatctgggtggccgttgggaaaattaggtcaaaggtgtccccagaaattggatacattgttgctaattcagtcatatagctggagtgggctggcatttccagaggcagacaacacaggcgtatgtatctgtttttaccactgaagagactgaggattggccaggtgggtgcaatggtgacttctcaaacagatcagcaggatggaagtgacactctcctggggcactgccgggatgtccctctgtgcgtagggagaggagtccgtgtaccttggtgacaagcctgcacccttctcttatctccctgcactgtagcatgaagcatattggccctgggcatgcactgcaggtgtagacatcctgtctgttcactggcctatgaactatgagactagaaacattacacagtctcaggaacagacggtccccttctgtttatttatagcttaacactaaatagctgattccaatcttattaaggtttactgatctcctattaaaaacctcaaatgatgtttatttgtctgatgcttgctcccaaagaaatgccccagagatttctctgaagacgcacgttattcatgcttgacatgacctcaggatgttgtttatggatatgttctgtgagcaaatatttactgaatttcaataataggatgggcactgtgtatgatacagagaagtatgtggcagtcccaaaaacaagtaaaatcaaattccttacagtaagaggggagttcgtgtctcatgtgggagagcagcagattacagatcggatgacccgattcccgtcttcactcagacactcaccagctgtatggccttgggcaagttacccaacctttcataatcaggacaacgatgtgatcagattcctgtcgtagaaagagcaccatacggcagttccagcaagggattgataggaaggaactggaataatggggatcgaggaatgagctctcacagggctctggatgggggtctctggagtctgagctgtgggcaggacaatggcctggagaggaggtatggatccaagaggcagcattgatgaggcgtgagacctgtttggataggcaggaaagggagggaggggtagagatagctcaggtgtgtcgccagggtgaccaggaggatgttggtgttattaactaaggtgggagaccttggggaaaaaaaggtggccaagagaggaaatgtagctcctttttggctgagttgtattaagaactcctcctccacatgtctgtgccattactctgtgacctgggccctgtgctccaaattcaaggaggtcacctagagtagctgaggatcagaaaagctatctaggagctaacacatgtggcagttttaaaaactcctttcataagcagtgaaataaatctggagagatgccctcctctcccctcagaggcctctcctttgtcgggctgggtggagtggggtgacagaacatcgatcggtgggagatagatgggaggaaaagccctcgttgcctgctgaatcaatgttcccttaaagactgcaacaaacaggattaaaggttgaaagacatttattgaggggtgaatctgggtgtgtgttttattagtcagcccggcactgggtttatagaaatgcccagcctagacgctgccaagagcaataaatcggggctttcttctttggccggctgcctgggcagtgatgtgggggtgtgtgaccccaggccaggaggatggaagagagtgttgtcttcaggccatctggggtagggtggggactcagggatggggaacgagaggaagatgattggccaatgcccctcctggcctccttctccaatcgctcacgaatgaggtcaaacatgcttactgcatggatacatgcctccagtctctttcagaattccccacccctcctgccaaaatcatttgcctaaccttttgcctgactgattcagaagctattaaatgcacggcatccacacagctggccattaattggaggccagagcttgattaatgagcattatgctaatgttgggtcagggggcagattatgtgtaaaagaccaaaacagtaagtcaagtcaaaagcaataacaccaccttccatccctccgcctccccaaacaagttggcagctggaggcaaatggagaaaaggcatattgatgagacagcctgcaagagcctggcacttgccttggttctttctgcagagaactgggctgagatgctccggcctccctcccaggaggagctgcaaccagctggaaggtgggctcccatgccaggctggcctcagagggacaggagcagctgagggttgagggagtgatacttcccagactacagtgtcttttttaaagaccctagaacttacgctaacaaatggtaaaagtgccctgctatgaatgtgtccacataaagtgttcatgtccaaacattaaaatgaacttggaagaacaaatcctgactcagccaccctggaatcatagatcctttggcaggtaggacattgcccatttctgactcgttacgctcactgaggtctccctctggtcactccttctgtctctacatcagacccccaatcccctgaagttctttctcccatcctcttttcatcacactccacactttctccaggggtgtgagtgtgtgtctttccgtgatgtcagttatcagaactgtccctcaagctacacatccaggcatagcctttctctgagctccaggtctccaccatgggcatgaccaactcacactgccctgtataagttctatcatatcccaaacacactctgctccaagctgaatttttctttctacgttgtatttgttactgacacacatttatttgatcccgtgctacagaaacatacttttcaatcttggtttgtcccatctcatttcttgcactgctgagggcatttttccctgctgtttccctcttctcagtgtccctgccagtttcctctgccacttactgaggtgaggctcctaccctctcttttgcatcactgcaaagtcttccagtgcctacctccttatccaactaaggggcccatgtcacctgagctgtccaatttctaagccactcctaggcaagacagctcttcatgcggagcctgtcaggcttccctgctgccaggctgcctcagaacacattccttacctccacactctgggtgtagcacacatttaaccctatttcctgcgcttcgccctgtccttgccttccctccatgcacaaggctaattgttttatctggaagagacagcttaggtccgtacctccctgtccttattcttggtgttgtcttggtgtgaattagcagggcctcaggtttctgtcatcactcctgtcctggaaatgattttatagatgattcaaacatttacttaacaatatagaaagcacacctacaagatcaggaatagcaagaaccaggggagacactaaatatatgaatgatgaaatcacaataaaaaacgaaactggcaggctgggaactggatgtaataatgttacatttctctagaataaatgtgaggtattatttttgattaaaaaatatttaaagagatatgggatagaagaggtatggtttagctaagatatcaattaaaaaattgtactgatggcatcatttaagataatgcaatatgtagttaccaaaaacgtaaacagaattttaggccatattgacataatctacaatccatgggaagagttttcaagtattcctcgttaggtatattacttggaaatatattgcattcaaagtaccgtacttaatggagaaatagacaaaagagcatgcttagtgaagatcagttaggaaaatttttttaaatgtgaattattgaagaaattattttccccagtactcctttcaaaactaaaattctgtgattgccttttatttgtcctgctctgaggccttttgaaattgtctttattcttttgggtctaaataaaatttcacctctttaaacccttccagataccctttatctgaattcaccgcatcctctctgatgataccatttcattttgcttgaacccctgcttgtattctggccagtcatttatattttcatcctctgccagcagatcgtaagcaacatcagggcaagaaccatgttgtactcatctttgtatttcagaacttagcagagttcctggtacctggggcatgatttgtaaatgttgaggaaacgcagatgcatagacaaaattgtccttaaaattcatgctaccaaactgaattctacctgtgagctgaaggttttaagtggaggctgatctcaaactacaaatacatattccagaaagagttctatggtcagttaagctggggaggtgttgggttaaacaaagttaagctggcttttttactacaggaatatttggagcctttaatgttattgtacactgtggatcttccaacaatagccattatacgcaggatctagcaaaatcatttgaccatagaacatggcttttatgcaataccatttcacatttcatggaacatagcttgcaaaatactgaacttagcctaactttagagaaacggcacagagccttttcaagaaatgccagaaattaaagtgaaagaggccagaagctggaaaaataccccacaaggcgaagaaggaggtaccacatactaagacacatactctagacttcaagaaacacacgtttaaaagcaaacaaaaaagttagtgatgacaatagctacaaaagtttgggacactctgaatatagaatcacaaaatttcctgatgagcacacaaataaatgaagtgctgaagaaatgggtgtggccgcagagggagctctctaaagagctcagctgagaggatgaatgcagaggcagaaataaatgatcagacgcacaggggtgtagaagaccagagcatccataggtaagaaagggataacacagggagaagtgaggacattttagaacaaatcattagtgtgtggactagttagaaggcacatgggttccttcaatggacatgtaacagacggttgtgaatggctagtttgaaaaattattattgataggttatgatattggtctctgcttttggttctacccttttcaaagacttaaatggtgaaatacaaggcaggattatcaaatttgcatatagtggccaatgtggtagctcatgcctctaatcccagcaatctgtgaggctcaggtgggagaactgcttgaggccaggagtttgggaccagcctgggcaacatagtgagaaccccgtctctacaaaaataaaataaaaataaaataaaaatttagatgggcatgatggtgtgcactcgttgtcctagctgctcatattcaggaggctgaggctccaggaggatctctggagcccaggagttcaaggctgcaatgacctctgattgcatcactgcagtccagcctaggtgacagagtgagactttatctccagaaaacaaaacaaaaaaagacaaaaaaagaaagaaagaaggaaggaaggaaaaaaagaaagaaagaaagaaaagaaaagaaagaaagaaaagaaagaaattcgcatgcagcaaaaatctgggaagagaaaggattaaaaatacgtcagctgcttagaataattgattgaaacaattacaagatgaaagtcagtagaagtaaaaataaatattttaaattactttaaaatttgccggggtatgggatgagaaagatctgacttcattgcatgtggaggggaggaaataacagggatattcacagtatgctatgagagaaaagtagaatttgtgctgcccaccatcactaaacaaataaaaatatatattacacaaagtcaaatgatcaaatttaatacaaacgtaatgtttgagtaaagagggtggtaatttcactgcttcctcaaaggccatacaaaatgtggagtatttgttctcatttaggcaaaatttgagagttatatcgacacaaagatttcattgaatgaagacgccctaggagagggaaggaaaagataaaagtcatatttgaagaaaaatggctggaaggactggagatacttaatttggaaaagaaaaggctttggggagacatagcttcttctaaacgcctgacgcataaaaagaaaaattggataagctatatggcttccagtgtcagaataaagagtaaaacctaggaattacaggaagaccgatttcagctcaatatggcgtattaaactttgtaacagctagtgctgtccagcagaaaaactaactcaccctgaaggtcctgcaggaactgcctgtcattccaatgaagtaatgtgcttgcaggtccctgacacagcacaggcccatgctccagggccattttccctctctccctctctattcatctgggctcagtggggaaacaggacccgcactaggtgtttcaaacagagataatttagtgaggagaatgaaataaatgaaccatgtgttcctgaggtgactgtggggagtagccaccgttcatggagacccaaacaaaggaagaggtagagctcttattagcacatgtctgctctaatgggagaccctgtggacttggtgctctttttttttttttttctgaatactggcacgtcagagagagcataacgagacttggtctgggagttcaaagggaaggtggaggttggggccacccacagctgctggggcctgtgccacctctgggtccacacagacaggaagagggaaagagaaggaagcatccttcccacatcttgcctttgcctgccatcctggtatcttcaatcggcaaaactcaaccgacagcagactggcaaaatgtttggaaaatgtagttcttagcattccagcctcagaacagcagggcaaagcatggctggaaacatcttgagctgagagacaaccatcagcccaggtgaacccttggactgctcagaatccacacacaccctcccacgcagagcgaatggctgccgcaatagcaactttgacttcagctatgttcattcttttgttctctacccaaatctcaccccctgtgccctcaggcagcacgtcaacctgttaggattctctccctgctgtgatggcccaaactttcactcctaaaccacgagccctcaaggctaatgcttactgctggacgtcgaaacactacactacatagtcccgctctttccccctgcccgcttgtcgccgttcatctcttttctttttcttccctttactccctccctcccttccttcttttgacctttcttcatttcccatttgcctgcaaaacatgcatgaagatggttgtagagggaatcctgtactgggttacaccgacatgtcctatattctccttcaatgcaaaatttccaaagttttcaatatgaacagattgttattattattgctattttgcataagctagtttcattgcatgcttatttgggccactagacttactaactgtccaactattcccaaattactctgtttatccaagagttcatatttaatggagaaaatttagaaagtacaaataaacagactaaaaatagctcatatataatcttgcttgcaggcaatcatcactgttcatatatttaaaaagcctagtcactttcctattctcataaaccacataaatgtatttataaacaatgtatatgtataatacacatgtctacatagtatgtacatttatatcatttaccacaactttattatatttttgtaattttgaggggacttttaatgtatatgggcatctttccttccacaaatcatccatagtgatgtttaatgtcatcacaatattgcagcttatgtctgtatcatagttatctaactaatcctgtgtcattgggtatttgcttagaatttgttgctatcatgtttgtgtaaattcatgattatattcatagaataacttttttactgcctccttctagttattacatttataacattttaattgcccaaatatttaggtattgtttattacaaaaggcacattaaaaaaaagtattgcaattttttactcttgtgtaaactttatgatctcttactgaatctgactcattatctgccctccagtacaatctctttctctcctgatcttctttaatagccaagcttaaatccagattattctctttccccttcttgctttcctcaacaaactcttcctacctggcaaagtttcagtgaatgcatctggcagtatagtttctgctccctggctctgttccttgaaccaaaatatcatcttcaaactttgaattaagatacaatgaggagctgacacttttgtcttgagattcctaaggcacttttcaaattcattgaaatccagtgcaatttaatacatattcattcaatgacttctgtgtgcccaccctgctagtcattgtgggaacgcacagacaccggtctgtcttaagacagctgacagcttgaatagacagagaactagttaatagagactatacattttttgaaaaataagtttaattgaagctaaggccatagcagcagctcaaataaggacagataagtgtaagtacaaggagaaggcagagtatagtaggcactcaggagatcccaggttcagtgcccctagccaggctatacaacgagatcacatcagggcatgatcccagaccctggacactatcttttggatctaacattttcttagcttagttctcaagtcattactagaagtagccccagaattattttcttcttggaagctgagaaatgaggtgtaagaaataatgtctcatgccagaggataggatacttggaattcttcccctttacctgtgaacaagcatttgtggcacgtggtctgcaaggcatggtggagaaagcaaagatgaatccatcctgtcctttggcagtttacagaccagcgtggaggtggtggagtggtatatacttatgtatgtaacaatcatacaaacttacatacgcgacatgcgtgctcgctaagtgttgtgtgttgtgagacggtagtacatctagcacgtcatgagaattcagaggaagactctatggaaaatagaattttgagctggatcatgcggtggggagcagaactggaatatgtaaagatggagaaggagagagcacgtgctttgcaggagtgagagagcaggagatacccagacaaatatgatgtctaccaacagcttaaatttcttcctgaaaaatcattcactttcatactaactccttagtcagattataattagtataccaccttccagatgaagaaattgagtcttacacataaagtgacgcctcagcgacactctcagctgccgccgacccaatgtgcatatggtaccttggctgcatggaagtgggcagtgggagaaagagctcagggaggggaactgaggccaaatactaattgtcttggaggccaagataaggagttcatatggggaattagatgaataaaaatgcagtaggtaatgagcaaataaaaacttttgattggaactgtgccttaggaaagatgcattcaactgaaggaatagtcagaaagaaggtcaaattagtagcagggtaggacgatattaggaatctgaaggctaacctaatatgagaagctattacaatagtcagtgccaaaggcaaaatcattctaaggagaaaatttcaccagttgacaagaatgctccccacagcattttcctcccatttctaaacaagctttatatgagatataatggacacacgatagactacacgtatttaaactgtacaattggataagttatatatgatcatcacaaccaatatagtgaagatatccattattcccaaacgtttcctcatgcctcttggggattcctgccttctgccctctccattccttcacacccaggcagccgctaatctacattctatttccagacactagagtgcattttctagacttttatgtacatggactcatagcctaggcattcttgtctggctttttttcattgaacataattatttcaagattcattaatgttattgtgttcattcctttctattccactatatgaacgttacctccatttatctgtccactcacctattgatgtattattgggttgtttacaggtttcggctattacagataaagttgctatgaacatctgtgtacaagtttttaatagacatttttttcatttcttttgggtaaatacctagcagtagaatgattagatcatacaatacacacacatttaaatttttaagtaatctgcacatcatttttatatcactaaaaaattagcaataatttaaataagtggttaaacatattatgatacatgcatatgatggaaaactatgaagctttttaaaaacaatgacagtgagtttatatatgacatggaaagatgaccataacataagagaaaaggcagcttatagaatgttacatacacattcaccgaacatttaatagtgtttatttagttttacttacttatttttttggtaagatgtttgggtgtactttcagatgtcacttaatttattttctttgtttttttctttttcttttctttttttttatgtttctgagacagggcctgtctttgccactgaggctggagtacagtggcgtgatcacagctcactgcaacctccacctcccaggctcaggtgatcctcccacctcagcatccccagtagttgagactacaggagtgtaccacaacgcctggctaaattttgtatttttgtgtgtgtgtgtgtatatatatatatatatatatatattttaattaagtaattaacttttttagtagagacagggtttcaccgcattgcccaggctggtctcaaactcctggtctcaaatggcctgcccgcctcagcctcccaaagtgttgctattacaggtgtgagcccctgcggctggccacttactttattttcataaggaacaggaacttttgttaaagtttttttgtaatctccccctcccctgccaagattaaggatattctaatttttgaaattgaaatgagtgtttggattgagggttcaactaatggtagcagaggcagtttttataacgtaagagcttgtggaatgggaaatgaagcatgactatattgcactgtattaatttttttctttgtcttttctttttttgaaacttcttattatgaactatgtacttttccctcaaagaaaagagtattttgtattttggtatacagaaagaaaaacaacaaccaggaatgagtgttaataatagcttgattattttcaactcaaatgcctatgtaaagtaacaactaatgtataacttatgcagatctatgcaaacaattatttaaattggaagaggaagcaagagatacctgagaatggcaatatttgctggattgctaatatgtcagaagggctccttgctacaaggccaccaaaatgagaaatgaagggcatttagcttttagggaactcagtgagtcttggtaggatgatattgggaatctcaaggttaacctaatataatgataattacctgtgaagtgctttattgtttctcaaacacatccacatacattagcttgcttagtcctgtgaaaatcctgtaaggagacaggagaacgatttattttaatccccatttgataaatgagaagagtaagcttcattgaagttaaataaattaacaacaaatattggtataactcaaagattttccaagagctttcatatgcatttctcatttaatcctcactacaacctcacaacaacctcagaaaacagggaacagatataattttatttctccctaccaatttttcagatgaaaaaattgagctaaattagactaagtaacttgaacaaagaacacacatggtgactttttcattgatacatcatattttacaaatttattgggtatatgtgagtttttgttatgtgcataaatatgtaatgatcaagtcagggtatgtagggtgaccatcgctttgagtattaatcatttctatgttttgggaacatttcaagtcctcttttctagctactttgaaatatacaatgcattgttgctaaccatagtcactctactgtgctgtcaaatattaatattagaacttgttccttccatctaaatgtatctttgtacccatcaatcaacctctcttcatccctccccccacacccttctcagcctctggtatctatcattccactctctgtctccatgagatcaacatttttagctcccacgtgtaagtaacaacatgcaatatttgtctttctgtgcctgtcttctttcacttcatatgccgatcttcagttccatccacattgctgcaaatgacatgatttcattctttttaatggccaaatagtattccagtacgtatagaattacttctgtaattagcattgtattagtattattgtattagtctatttcacactgccataaagaatacctgatactgggtaatctataaacaaaagaggttaattgactcccagttccacatggctgtggaggcctcaggaaacttacaatcattgcagaagacaaaggggaagcaggcagcttcttcacaaggcggcaggagagaggatagaggagagcagggtaaactaccacttatgaaaccatcagatctggtgagaactgactcactctcacaagaacagcatgagggaaactgcccccatgatccaaccacctcccatcagttccctccctcaacacgtggggattacaatttggattacaattcaagatgagatttgagtggggacacagagctaaaccatgttacttatctttgctattgtaaatagtgctgcaataaacatgcaagtgcaggtattcctttgatatacagatttcttttcctttggataaatacccagtagtaggtcagctgcatttcaggtagttatattttttaatttttcaagaaatctccacactatttttcatagaagttgtactaatttgcattcccaccacagtgtacaaaagcctcctttactctgcatcttcaccagcacctgttattttttgtctttttcagcaacaaccattctaatggtaatatcttattgtggttgtgatttgtatctcatgataaatgatgttgagcattttttcacatacctgttggtcattcgtatgtcttcttttgagaaatatctattcatgtcctttgtccactttttaacaggattttgtttgttttgccgctgaatcatttgagtttcttgtatattctgaatattagtcccttgccaaatgaatagtttgcaaatattctcttccattcaaaaggttgtctcttgattcttttggttatttgctttgctgtgaagaactttttagtttaatatagtcccattggtgtattttcatttttattgtctgtgatttgaggttttagtctcaaaatctttacctaggccaatgttctgaagtgtgctctatatattttcttctagtagttttacagtttggggtcttaatacttatgttatttataccatcttgagttgattttttccatggccattttaatgacattaattcttctgatccatgaggatgaaatgtctttccatttatttgtgtccttttcaatttttttttcagcaatgttttgcagttttcctggtagaaatctttcaccttcttggttaaatttattcctaggtttttttcctttttttttttttctgtttgagctattgtaaacgggatttccttccttttttctatctaggctcattcattattgatgtatagaaatgctgctgatttttgtatattgattttacagactgcaactttactgaatttatttatcagatctaagagtttttgggtggctgcttgataaacaatttaagctccagacttgggctttaaagccaatgttctttaatttattccacaactgcagtatgcctgagatcatagtgctagtgaatactgaaggcagtgcttaactatggtcttctcaataactttaatgctccttacctaacatagtctgagcattcctaatccaaaaatccaagcttattgagcattgacatgatgccacaagtcaaaaatttaatacctgacctgatgtaatgagtctcagtcaaaatgcagtcaaaactttgtttcatgtgcaaaatcatttataatattgtataaatttatcttcaggctatgcgtaaaaggtatatatggaacataaatgaattttgtattcagacttcaattccatcccccaagttataacattaggtatatgcaaatattccaaaatcccccaaaatccaaaattaaaaccatttctggtcccaagcatttccagtaaggaacagccaacctataccatacaaccatgtcagtgtgaatgcacattctttaccttgtattgttgttttatttactatactagaaagcttaagaaattgataatggtgtgtgtgggtatgtgtgtgagtgtgtgtgtatgtgtgtgtgtatggtgaatggtacagagttgggaattcttttcaagcccatttggaaagtgcagcatggagttgtggaatgatgtatggtattgttccacacagctcatgactcctgtactttgtgacaatatcttatgtcatgatgaaatacaatgtgtgtagttagaaagtagagatatgccaactggctctgcgttttgattagattatttactgctaccactcttaccctgtttaaaagctttccttctctacagcatgtctcaataaagctaataacttggcctttcttgcttttggaaatttcttttggggagcttttctacattgtcaagtttgaggatgatattcattgcagtactgcctactaagaatttaatgattggcttaatattaagtgtttagtaatacttttctcatttgtatttaatcctaagtattttttccaaggacaagaaatttctatgcataacatgataattcatttaagttattgcttaacaaattattacatttgttacaagctaagccagggcccatgtttttctcttttcttggaaataagagggcagactaatgcccttggagttcacttagcttttccaattactcgacacttggttgcaccaaatctggttggtttgaatgtttctagatgggatttcctggcattctgcctatcatgaagaatgccttggatttttagtattattcttttgaaaatttaaaatatcttcttataacggttttaaattcatttaattgtatagctatgtttatcagacacagagaagtcaagtgaggaatcaaatatccagggcaaaatcctgagtgtttggatatagacctttactgcacccggctgaataccatgctgggtaggaagtgcctcatcccagaaagatggctcctatcctaagtggaggcctcactaatgccttcttattttcagaatgagtttccttaatgaatatcagcttgttctagatttttaaaagtgaggggaataaaataactagctttgatagaaataggatatttatgggaacatgtagataaaaaagataaaaagtccagcaagaagatctgtggtgctctcatagtagtgtaaatgtgttttcccttcatagtctgcctcaaactgtttaagatggttggtaaactctccaaggacctgttctttttttattctctcataggcttgggaggataaggacacacttaccttggaccaaagtagtctggcaacagatcctttcacaccattataatgctaggtacactgtgaccttaatggttggtcttaatgcctcaccctcatcttctcctctgctgtggtcccccaacacccttatctaacaaacaaatactccctctccctctccctcacctctttctcttcatctgccttccctcctctccctctcccttctcctccctgttcttctccttcccccccccacctcaccttttccttctctatattcctcccctcttcctccttctacctttccctctccccctccctttcgctttcacattggactaacgagaaccaaagggagtgaaagtgtgaggatttttcacattgcttccctacctgcagcaacaccacagaaattataataaccagccctggcagggcatattcctccaaggactgcctaagttctttgcatcaatttttacctagcctttgggaggagataagaaacaaggaatgtaatttcccatctttgtagctggccagggagaccagtttgcagacactgccaagactcatgctgagtcaggaaacaggcccacattgcacccaacattctgctttgtgttcagatgctgggctgctactggagaagtggctaatggggtgctaaatgggatcagaggttgctccccctgaagcaagttatctgtggatgtttgtgagtgtggtggaagaagggccagaacgtacaagctaaaagaaaaggaaaagaaaataactagtctttgacttctgtaaaactcctcaagtagaaacagatgggatttgtgactaaattgagctattattagatgctaaattggaaccactcttaactgtgccacccttctccaaagcactgctttactcgaaaggccctgattatgcctctgtggcttttggcaaaggtaaactgaatgagtaaacatgtcaaattttaattgtctgtctttacactagctgttgaaagtggtgccatcttcaaagagccaaaagtacatgcagatccgatgctgggaccatttttccattccatttacacagtggagtcattgaagaaccatttctgccctcagtctcccttgatgagctgaggatggttgtaggagatggcggttggagcagggggaagagtaacatgcagccatgtctttagcgacctgaagagcctgactcctgcattccggctgggtgtggtggctcacgcctgtaatcccagcactttgggaggctgaggcaggtggatcatgaggtcaggagatggagaccatcctagccaacatggtgaaaccctctctgtattagaaataaaaaagttagctgggtgtcgtggtacatgcctgtaatcctagctacttgggaagcttaggcaggagaatcacttgaaccagggagtcagaggttgcattgaaccgagacaccgcaccactgcactccagcctggtgacaaagtgagactccatctccaaaaaaaaagaaagtgcattcgatgattggatggggagaagacatgaggggtgagtgaagggggaacgctcgggttgtcccgctgggtgtccacctccctgctcctctgtgccttctattggtgcctcctgagtgttaggcatcaaagtgtggctgggtggtatcttggacagaatcatagttttacactcatctcttaaataggtagctcttacatgtgaatgctctgaggactaagtaatctcaatactaagttgctgtggaagccaaatattacaaacaagagagcaaaatgtgttgctgctaatgctaagaagtagagacctgggtattctttttttttgagattaattcctcagtgtgacatttctgcatccttccacccctttggcttccgccttcttctccccatcatgaagggatggttttggagatcaagggaagaggaagaaaactgctgtcttccttcccaatttcaagccccagctcagtataattccagcctttgttttgacactttttatcatgttcccagacacattgagctctgttcttccccatagggaaggggtgaagagttcagctttagttcgggccatacttcccttctttttcctgatcccctgaaaagaattgctgacactcgcagctgaaggcactaagtcatgcagcctcacgtcggtgacccactcacctcccatgccttcaataaacctggcaggcggggctcacgggatcatcagactctcacagcaggatttgtattcgtgacctgatttacacttttccctgcctcctgccagtaatttgtacggtgaaacatttgttgagaaggaaaagaggaaggaggtggtaacatatttctctggccattagcctgtgtgctttagggaacagccttctctaactaaaaggtaaaatgaaaggaagagaaaacgtggggtgtggaagacattgccagtagcctgcaatatctttccttccttccttgctaagaggagccattgtttggggcagcaggtgccccatcccaaggaccaaccatgttccctaatttccagcatcctttgcagctgtggatggccatgtggcctatttttttgccattgggttgtaagtggaagttggattccaagagagctttttcataacccatgaaaaactcagttactgctaggattacacttttctctttttgtcagcagccatcttatgaccaagaggtgactagcatgaacacaaatgccttcacactgagggtaggaagctggaaagcagactttagacagcagatggcatccttgaatatctcaacactaatgcctttatgtccccagacttcatgttctgggggaagaatcgatctctattcatttaccctaccatacatgaggtatggactgcatgtctgtccctccctattcccgtgttgaactcctgaccttcaacaggatggtatttggaggtgggacctttgggaggtgattagatcatgacagtggggctctcatggatgggattagcaccttatataaggagatatgtgagaaagatggtttttctctcagccatgcgaggataataatgagaaaaccactatctgcaaaccagaaacagtccttcgtcagacaccacatctgccagtgccttgatcttggacttccagcctccagaattgtgagaaatgtaagttcgctgtttaagtcaccgagcctatggtattctgtaatagcattccaaatgaagacaacaaattgtgactttctttctgaagcacttctagcagctgcctggtgtgactcagtgtggtctccaagagactgtgcaggcctgtgtaactctgctgactgcacatctggaggtggtcggcattgcacagcagtggttcccaggggcagaatgggtatataagtgtgtgtgtgtgtgtgtgtgtgtgtgtgtgtgtgaaagagagagagatagagagagaggcagcagtggggagagtcatgttgatgaaaaggaaaaagtcagatcatgtgaaaatcttccaaatcaaatatttgaaaaagttgtgactaaagagttggagtgacagcatcagtctcaatttgataaattccacctgctataaataaggttaagcaggcccctcaccacacaccccccacaagctctctgccacctgtgttcacctgtcagagggtccaatccgctttttaaaaaatatattcattttgaaaaaattcagagttctcactaagtgccaggcagtattctaagaattgggagaataaagataaaaagaagggctggagctcacattctgtttatttttcagtacatgacatacaaacttccatttgatgcttaaaataatattgtgaactgagtagtttggtttgttttacctttttacggatggaaaaactgaggcccagtctgaggctaagtaatttctccataatcacgcaatcactgtaagaactgaaatttgcaaccagatctaagtccagagtctgtttgctttccactgacctgaactattaatttctgtcttttaagggctcccagtctaattagaacaataggaaatatttgaagtcagagagatcagaccagggctcccacctctactactgctctgttaatgtgtattagcactgtttcatgtgggctcttttatctgggaaatgaaaatattaatatctacttcatcagctagaatttagtaaaggtccattctgcaatagctggtagtataggtggtttgtacatgcacatgtgcatgcgtgtaggaatatacccttaagtgactgaactaaaatttgatagtcgtacttgctctttacaaaggactgctgtttacaaacagaggtagccactgaataactgagggaaatcgataacaacattttagaaaaggggacgttggagctgggacttaccgcatgataaccactgactagtctgagaagcgggaggagtaggagtgggaggccctcttagcagaggcacctgtgcatgaaaacagatgtgctgtgcagcgtcagggctaggtcactgcgagcttgatgtggccagcagaaagcggggtggaggtgagattggagtatacctttgaggtcagcctgagtaggttcttgggtaccatgctaaaccaacagagacaagtgacctgaaattcttcactccctgcaaagaaatagagagagcctcctcttttgctcggcttgggatacagcttcccagagccccactgacctttgggggtcgtggtcacgcacagtgggagggggattccttttctttctgcgctttggccctgccatacctcctttcacagctcacctgcttgaggtgttgctttccatgcaggtgcgagaacacacgtgcataggaaagactgtgcctctgcacctccccaacccgacagcatcttgaaaggagaaaatggctctaatggaaatctctattatagcaatagccaaaggcactgcttttaagtagtattaaagaagcagagaggagaccagcccataatccgtgtgccttttgctggggggatcccattttctcacataaggagaatttatcctaaacaaggtaggcttggtcacgtctggaactactgaaagagagagaactcaccacaatgccatctagtgcgccccacccctcggccctctgcgctgccttggcgaagactcgtttccacgatcatgttctgttctgcccaggaagctcctacggcacgtgtaggaagcgctgtctccatccatgagtagcaaagtggagcccagtgctcagcgacatgatggggtttccagtagccgcggggcctttgctgtcctccctcagtcctggataaatcatgacgtgcagatatccacaccagccactcgacagcccaatccctcccttgaacggtccttccatggggcagggtattgccctttcttgtcatgcctggctggcctcgcgcagtgtcctgggaatcttacctaagtaactaagctgccctatgggaatgtagtcccatgtgaaaacaagagagcacgctggtttctctgcattcccttctgagcagctttagggcacagagctattgcagacatcaccaccctctgtccatgttaaaaggagaaatggctttgattgtggacaactctagcggggcagaaggtaggtagtgggattaggacgtgggacagtgttgatttcccaccgcggggccagtgggagtttggaacggatctcctcttatccttccatcttggtggagttcatttctcaattctggattcccagcctaaggcagggttaacatgtgtgactaatatcatctccacccaagatgtttctcacctcattcccttcagccagcccccgctcttcagccccacgtctcccgttccatttatctccatcagagagagatggaatcttccctggcgattgtggcagcttgacaagcttctgtttttccaagtgaataatcctctttgtaggacatcaaggaaacagctcacttccccggaggcctaagcacaaagccgcactgctccctgggtggtggatgggctcctggtcctgtccgaggggaggcagcctccgaggggaggcgggaagggaagagacaccgtccaggaggagcagggcctttccagagcggagcaagccttcaggttgcgccttgcagccccgcggcctgtgctccagagtctccatttcactgcggccagccggcttcctgagtccagcatgtttcttgttcattcttgacaccacgcaccccttctaaccccgagtctcctttttagaatcccaagtcacaccaccttctattcgatgggctctacgtatcaggaaggtacctgtgactggtggaaggaaaatgcacttagcagtaattagaagctgagctcagggtgcagctccagggacaacgcccgcagccccgacctccttccctgctcagtccagcacaggaggaaggacaccattttctccggcttgcaggtgccgcgtgcctttgccagctcctcggacggcggcatggtggttgctctgtccctctagaagcctctgcgctgcaaaggtttgtcgggtcatttgacagagctccatgcgtccctggagagtgagggccggcgctgctgtcccgcatgctgagctcattagtgcagaactcacttcggcaactgtggaggcagacagcatgaacaaagtgcacctgtgagcgacactgccagcccttgggagcggctgcgggcctgcaggggtgagcggggcgcggcgtggctctctaggcgcttatgggggcgggaaatggcggtgccccggagtagctgcaggcgccccgggatagctgcaggtgccccggaatagctgcaggtgccccggagtagctgcaggtgccccggaatagctgcaggtgccccggagtagctgcaggtgccccggacctgtctgcgcgccgggacacgggtgcactgatgcgcggcgggcgaaccgcttgctcttcctcccacagcataggtgcattttgtctgcaagaacgcattggtggtgtcctgatcgacaccgccaggacctggagggggtgcctggcacagtgaccccgacgttgggctggccccagccttcctcttcttcctgctctgtgtggaaggggggccgcatcacccttggttccaggcagccagcgagcattgcgctcccggaaaccccctccacgcgggacttcaccccagagggctcgtctgctgaataaccgtcactcaggcagcatctggaaattccccgcactttcaggctgagatgagaccgcatgcctgggagatctcacggacagcgccggcttggtggtcaagcggtgggaggccgaaggccccggcctttacaacaagcggggggtcataggaagtgtcccttggggctggggacccagggcagccgtgcggaagggagtcacccaaccagagcacgaagcgcaaggccgtgggcagccccgcagccgggcgggtaggactgccaggactcaggcattcgagcacttcacgtgtcacacatgctgcggagaaccatttgcccttcgccacagcccttagagtatctaccgcgtgtgactactgtggcctccacttccaagagaaggaaacgggagtggagaggtgtttagttgcttagccaagctgcctgagagctggagctgatatttgaacccgggcaagtctgactccaacatctgtgttcctaaatattccccacgtggccgtggggaaggtcaacgcaatgaataacgagaaagaagacacacagcttagacagattttatgaatcagaattaagcaacataagttgcccgtctcccccttcttccctcctcccttcttccctcctcccctttctcccctccgtccccgcttccttccttcatttctatcagcctttattgaaagcatcctacctgtgtattttccacaattcctgtcaaaatcctgtgctcccagaagcggagcctctccgtctcttggctccaaagctgtctgagcctgccctggcttcagtccagaggagaccggcttccttccttcccctgcgggcatcgtcggcccttgcattcgcatcctttgcaggtgaaggaatggcatggaatctcgcgtgagaacttcatggttccaatgtcagaattatgtagggataattagaattcttaggccctggtgtgatgtagtaggaagaaaagaggttatggagttggccatagataaaatagaatctctgctctgctaacttctaattatgtgctttcaaaaaatacatttcccttcctggatattcagtttcctgatgtggataacccatcctgatgggcaattatacaagaaaattgatgttaagttcctagcacggtgcctggcacattgtcaatgttcaataaactttagttctcatttctctgtttctagtgggattttaagcatcttgggatccgtgttcattgtgtttatcttcacatttcaatagtgccaggtgtacacacctttacacactgggttcacatagctttgtggaacagatacagaaatgaatgaatgaataaaaatgagcaaataaaagccttttaatggataaatcctcttagatcttccgctggttatcattctcagattttcatttatattggcgaataattgagcaactaatacgctaaataccgaggataacaagataagttaaatatgctccattccatgaatgagcttacagttaaatgtggagacattcataaacgaccacccacaatacaaatgtatagaacaccatgggcagctgagggacaagagcttatctattttgctgctttgataaatagcagtgtacttatttaatgtattaaattgggaactgatttaatgtatctgatcctctgttttctcatcggtcaaataagggtggggactttggtgactctgcctcgaagaactttttcaagtatttaataaaaattgctctgcggagtacctgacacatagtagatgctaaataaacgctcactgatgtcagcactagtcatatatagtcatcagtgatatgctgcagggctttttcacttccaagacaacatcattaggatatggcatcctcatgaatgtgaacaattacaaaaaagaatggaaaggtacccctgacagagggaatattttgcatcagctcagcagccacagacatagacattgatgagtacggctggagaataaacgaagatgaggaagtgggggtgagaaacccaaaagcctggatctcagaggaatttatatgtcaagcaaaagcatttggagtttattttatagggaatagcaagcgaatcaaacactttaatataggaggaaggtgatcagagctgtgtctggggaccgtaagttaagttctcttttcaaattcctctgatggcttctcctataattcagaataaacaacaaagtttttgccacaatcagtaggccccctcccccaaatcatccctcatctcctatcacccctggtccccccacctacacacatactcataccctgcagcccagccacgctggtctctgtaaacccatcagacacctgcttcagcaccgttgttcttgttattccctccactggtcgggggtggggggaacacctccagcaggtttctagaaggaacacgccttccccccattcagggctctgctcaaatgccagcgagtcaggcagggctttcctgagcatcttttggaaatagcactgcccgtcagcctgtgtgtgcttaccccactgtctcatcctcagagccctagcactgcccaatttgtacctctctcaattacactgtgagccacatgagaacaaagagtttatttgcatccttgtacctctgtcaactacactgctagccacatgaaaacagcaagtttctctatttttttccagtaccttgaaaaaggcccaccacaaaagggggctcaatagatatttgttgaataaatgaatcatctaaatgacgacgaagaaataattggcttgtccaatagcacaggcatgatgatgaagccctatgtcaaggcaatagttggggtgaagatcatggcatgctttggttgctgagatgttagatttatgttatcaagtatctagtcagagcccaccataagtgctgtgaatacaaaatagaatccctgcccttctggaacttatagttcactaggggaaacaaaaccaacaatacaagtgatgacaagacagtgcaataaagagatctggaaaacagcatgttgtggagtacagagatagattaaatgataaacattttcatcagttcattcattgctcactcattcaattcacccattggagaatgaagaagggaaagtagaatgtttccacatgggccaactatgaagacgatattgctgttagctgagatcagaatgcctttggaaaggctgggggaagactggaggggccctcgcactggagtgtctatggtgtgcagtggggtaggcctgaggaagggaagtcatgggtgcagatgacttccccgggaggttggctggggacagtggagagtggagagaacataaaggcaaggctctcatgtagttacgattgtgatggttgttttgaagggatttgaatgtgctagtagcctggcaggaaaggaggaagtacaaagaaggtgctaaacactcactaaatttgatgagaagatcaatcctagagaagacagggaagtgtaggcttcacagcagaatctttatcctttgaaaaggaggaggaaaattcttcctcagaatcatcacagcagctaatttagggtgtggacacatttttattattttttgaagaattatgggccctcactggacattcttgattttcttgtcaaagaataaaaagatgagatttgagaagactagattaaaaaggagtgataagatggtactctgaagatttggtagcaaattcagcagtgtcttcaagcccacatgtgagctgttgccaagaactgctgcagataaacgttttcccaacacatgccctttttacagagctgtagcttatcatccacatgtttatgtcaaacatagtgccatgtacgttccacatattctgttaattctcagcacaaccctagggagacatgggttattaactacataaagttaagtgtctttcccagagttgggcagctactaagaaggagaatcaggtttgaaccctggtcaaagtgtatgtccatgcctcttacttattaggctatactctcttaagtgatccacctgagatggttgtttcctaacaacgaccatgcctggggtagtgtagaatacataacagttattttttagggtctccagtctgagctggttctaggagcactgcgagaagtggccatgagtttctacctgtgtcctagagcaaacggttgaatgacaattcaagtatataacctactttctcagtacatctctgtatggacatagggtgcccttggtcttgagtgggattagctagttgtctagttttgaaagagtcagctcctaagatgacaaggaagtttgtcttgattccttctgcagaaaagtccttggagataaactgtcagctaagcctgtccagtgaatggtttgcatggacacgcgcttttaaaaaatctgaacttgacctggatgagactctgaggttccagaattaatatatgtcctgttcctgccacacctgtgacaccgtgaatttgtaaccacagacaaaacctggacaggttccatgccagccatgactttaattaaagctatttagaggggctgaaggctaatttataggtgattgctagatgggttttctcaagtctaaaagtgccagttcaacaattaatgatagtacagggcttaattggctcaagttaaacaagggaaaagcaaagagggagaggaagagctgatgggatcctctgtccacatggtgacaaggcgcctgacaaccctctggctcctactttctcacacggtcagagaactagagaggcaggtctaaccccgattgtggagaggcaatagtgaaaaggaactccagctcatttcttctatttaaatgtgcaatagaaacttgttgcaacaaaactatttgttagattcagaatctcagcagctcagagcataaactgcggaacataatcacaaaatagaaaacatccttcacctataatcggatgttagttctatgttccaacctgggcactttaaagccctctgattatattttttaataatgtaaatttagtggtggtgagagagagagagatagctgcctaaagaatcatgctataaaatatttttaagatagcattgggaagagagattccagcttactggaaatcattttctgtcattcttaattacttattttttgcctggttctacaattcaacctgtcctctcaccaatgtcttgaagcctttagagatttttctctacttgctggaaaaatcacctaggttattctgaatgcccactctatttaaatccctctgtccttctaatgctaccagaaaaaggagctgattagcacggctgttaggaacatggttccctctgcacagacagagaccctgtgaactgcagaccttgctcgctgcaactgcatagttctataacctttagggacctattctggatttgactgaaatctattttaaatgactgagaggtacctacttaagacccctatatcagctaccatcttggttttaggatggcagattgaaccactggaattatttcttggactcctagagctgaagcgatgactgaaatcatgcagtgcagtaggaagggcactgggctgagggttgggagaagagaacccaccttcagggcccagctgtgccaccgacatagtaggagttcttaggctgaatacttccccaggatcacagccctgtatctgttaagtgctagttttgctctgaatgacctagaagtttttttccaaatctctttttctgtaactctcatttgtggtcacagatttagttcatggatgacttaaattaacaatcctggatctttgattctcaacccagtgctctcagctttctgccttatagacttgtattatgactcaggacatgttgtgaaaattggttaattccattaacagttaccttggaactgagaaacaggaagtgctaggaggatgagctgcaacagagacctcgttttgttcagtcaattagaaaatggactgaggcttccaaatctattccatgtgggcagctgctattacatttaatttgaaaagtcattggcatcgacttcaaatttgtagaactctcctcttagtcagttaactgaaagcccttaaccttgtattaaacacatattacctttgttaggcagactaaaccttatgacctttttcttgtaggtaaatggaatcaagagattagtaagacgtttgtgcacctagtagctagtcattttctttttattccatccttgtcctctctaacctcagttgggattgttttcagttttctttacagatgcctaaaagtttatgtactttttacaacttatttgaggagaacttatctttctacaatttcacattctgtaggcatgtaatgtcatttttattgctaaggcatttgaaaagccaatttcttgaactgaatacctttccttctgtaaatatgcatgctgtgttactttgcaacaactgatcctggatttaaaagaatatgttgaaatcaaataacttttcagtatttactaagcatctttctctcataacactcaaaatattgagtacacagaaaatactgcaaatgagagatgacagctgttattacttccagttactaaatgcgaaagtagaggtacttataaaagtggaccaaagttaaaataatctgttggttaacaaaattctggctttagaccacttggattgaaatattaccacctgctagttaagcaagttacagaatttctctctgcctctgtattgaatctgtataatggggataatatctcctttatagggttgttgtaaagataacattttatagtaagcattcagtatgcattgattcgtatttttcttcttcctttaatcatcatcaccatcactaccaccaccatcatcaccaccaccaccactaccaacacgtcaccaccaccagcaccaccatcactatcaccaccactaccaccaccactatcaccattatcaccaccatcaccaccagcaccagcatcatcaccaccaccatcaaccggttggtgaatggcatcagcacaaaataggacataaatagctacttaggttttttataaacgccctttgattctgcagacttaaatctggaacactagaaaagcatagcacagatagacttaaaaatgggttttaggctttagtatagagaggatttgctcacaccttactttgatagaatagcagccctagaggcaaaaaaaatgtgggaaaagagaaagacaatctgcttccatagcctaaaataaatggacagaaatgtgataaaagggatatatattttttctttttttgatgtcatctaagtcactgtgcccactggaagggtaaacttcatatagctgagctccttcctggaaagttgatggaacagcaggcataaagcctctgattttgttttatctacatcgtccaaaagcttacatccccatgatgctctgggataaagtcaatctaggaagaatctggcatggtggcagagtggctggaagtagagagcaggctcctgcctgccaagtgaggatcttaccagttagacagtggtggcagagcagatgacagtgagcttactgatttccttagagagaagggaccagaggctttgaacagactgattcctttcccatcatctgtttctgtggcccccatcaacatggagaccaagcacttaaaatatgcagtcaagccagatgctccccctcatccctaaagatgactggccaaaacaggggcttacaggctggtcacggtggctcatgcctgtaatccaagcacattaggaggccaaggagggtggatcacctgaggtcaggagtttaagaccagcctggccaacacagtgaaaccccatctctactaaaaatacaaaaattagccaggtgtggtgcatgtagtcccagctacttgggaggctgaggccagagaattgtttgaacctgggaggcagaggctgtagtgagccgagatcacaccactgcactccaagctgggcaatagggtgagactgtatctcaaacaacaacaacaacaacaacaaaataggggcttacagggcaaaggaaggatgctttggataggtgtgattctgaggcaaattctaaggaagagaatgaaacctttaacctttgaaaaaattttaatatggaaatagatatttagacatacagcctataactgcgacatttattgggcacctgtcgtatgttagagactttgcaattacctaatttaatgtatcattatctccatggtaatggtaagaattcttaggcttatttagcaggtgaggaaacagaagcacaaagagtttgtaattgtcccaaggtcatgaagtttgatttgaacctattcctgctgattccaagtctaatgcttcagtgttaagtagtctcagcccttgaaaaatattatttttagaaatagaaatgaaaacagcgatttttactagtctagctctcattccccttgtgttcaaagaaacctcattcattcatttgttcattagttcatttattcattcaatagtttttaagcatctactacaccatacgctgtagtaagtacaaggatatagcaataaaagagttaagtccttatcctcagaaagattccctatttacatccttactgattctccatttatattgaagtgaaagacataataatgcaaaatacatacgtagatttcttctgtgaaatagaggagtgatacaaaaagttgctgatggtgcgtttgaggtacttcagcacaggcattcagagaaggctcactgagggctagtgtgagaagaaaacaactacttcatgatccaggaaagagcattcccggccaagaagaggtcaggtacaaaaggcaaggatggcagcaagcactgcttgcttcagggggtgagaaataaggccagtcaggtggaaacctggtgacaatgggaaagcttcaggaaacggggtacctaaattggtataaaccagattagccaaggcattgtaggcatggtaagaagcctgaagtttattctaagtatatagtaagtcctgaaggctttagccattagagtgaaatggtctgatttaagtgttgagattcccctcggtgatagttgaagaattgattacaggggagaaggagcataaataggaaagtaagttagaaggctattgcaataacccaattgagaaacagttgcaaaacctgtgggggcagcaatgaaaatagcaggaaatgaagagttgagatggtctttggattgaatataagataagagggaaaaacagaaaaagtcaagatgcttgctggctttaggcccaatcagctggctggatggtagtgtcgtttgctaagactgaagcatctcaaggttgaaagttgtttgtgtggggggtatggcatggcatgaaattccattcatgtgtacgtgtgtgtgtgtgtgtgaagtatgagaagcctgttggattcaagtgtgcatttgaatgaattttgtgttcaggaaagtgaactgggttaaggatataggtttggaaataaccgggttacaaatggcatttaaaaccatgggatttcttgagaccctcctaggacagagtgtgcaaacaggagactggaagacctaggctagaatcctggggtagcccttcttttagaggtcagaaagagaaggagaggcttaggtgacccagaagtagcaatgacctaacaattaacaagcaagtaaatgcagtttggtgtcacagaagcgtggagaggcaagtatgttttggggtttatttcttgttgttgttactgagaagagagaaatacagtgggaagatgaaatgacttttggcaatttggtaagattgagtcattgatgaccttgataactgcagttgtgttggaatggatggagttgaaagctcaattgtagtgacttgataagggaatgggacatgagaaaggagagagatggagaatatagaaaacacttttctcaatccactcctaattacacttagccccagaccacaaaaactagatattgacaagattttgaaaggccatttgctgttcctaaaataaccgtggcaaatcgcgggaaagccaattttgtggtcctgctttgtaactcagtccatcttaacagctttcattatcaagaagttattccttctattgacctgagaggtatactcctattttaattttatggagatagagacataggaagtttcattaaaaccccactccttcctcatgtgcattcacagcccttccacctttctgcattggcctgccgtccaactctctatgccttatacctctgtgtgagccatcacacagtttccagatagtgctgtgtgcattgatcatatgttggaaatgttcactgagatgtgagttcccagagagaagaagctgcctgtcatcaagtgtgtatgcctagtacataggaggtactcattcaattgtcattaaagaaatgtttttgttttgcaatttttgtctaatctacattcatttgcttgcttctccttaaggtaaaacaatggtactcttggccacacactatatagagagtatgtgctatttcatgtaaaaacaatagttcagagagaaaagtgtgattttcttcccattcccatttgggatctctaaactcagctcatattttggtgggggtgacattcccatgctattattctgtcttcacattgggatctccatttctgggaggaagatagatgctaatttctttacaaataccttgctttctcacatcttactgatgttttcaacttcaagcagggaagaaagtctggatgattctccattaagagtgtgctattaaaattgtcaatttcttgaaatacatggttgaaaaaccatcattttttccccactgtgtgttaccctaaactatagacctgtcaccaggcagtgttctagcgtgtgggtacagagaaactgtgggaagatcccagtggcacttaaattatattctccttttgatttcgaagacatttagtgccatttagcagaattccaatgcagttggttccacagaaaagggggctgtcccttttagaggcatcattgctgcagtgactgagaaaaagaaattaagtcatcaaaacagcaggttggcttttctatccagaccatcgtggaattaaaaggacaggaaggctctgtgggctcctctgcagcccgcgatggtattcactgcttcatatctgttccaacgctgagcagaacagaccattgacctgtgtccagtccactagtgtttcaatgaaaagttgatttttaaaaggaggccagggtacagggaagaaatggaatttcatgtagaaaaattgctctttctccctgatagcttctaaagaaaatatgctctgtgcataagtcaaaatatttttttttctgatggtttagcatgtcccactatttccgtctgggatctgaaagcacagctgtgttcttcctgtctcacacctcatcttcagaaagaaaatccaccgtggggaatgtggccacagacagaacaaagtctataggaaagaaaggcactgtgttcatggttgctcaggtgtcttaaacagattttgtaaacattatggagatatgggtcaatatccctgaagaagaagggattcctattgtttctcggatcccactctccacttgaagtatagggtatcaccatgcaggatagacccggctgagtgcagcctgtgatgatttctgctcacctaaacttctcaataccatttacagtttttaaaatggaactacctggttcaggtacttcccacaatacctgaggaattaaattaagaggtgagaatgagcacaatgctatctaagcaactagcacttaaaaagttaaacatctccctcaaaactgtgcattgctaagtctataaatgtatagatcattatatttatagcacaatgtacagagagaatggtcttcatttccaatccatactcaagagagaactgtaaaatatttagccaagtgtggctcagggaatgcccttggtcttgaccttgttctgttatcctcccataaaaataacagctcagagttactgagtggttaccatgcacatgcactgcttaaaggctccacatacagccagtatgaagtagatacaattaatgcgattttaggttgtagaaagggagtcagaaaagtcaggtcccatgacgaagcccccgcacccctatgacacacagcttagatcacacccaggcctgcacgctgaatccttctgctcccctgtgtctcagctgtggtgagggtcctctcccagcagactgcagattccttaaatgtcaaggccatgtcttcctgatctttacatactgctcatggtaggggcttcataattacggtataaatatcgatgaagtctgtcccacatggtctacctcacctcgacatggtttgacttatcattctcttgtatcacggcctttatactaacttaaatgaatttgtaatttctttatctggatgtacacgtagatcaccttctagcatagcattttctaagaagtgttattcctgttaaatgctgcagcaagccacgaagtctcagagctttgtgccaaagtcccccagcctttcagaagttacctgctcctctatttgtgagtggcttctctcagcagcatcagtgagggaggctggggctgtatgctcctctcttgcagattgggcagcacccgagtaagcctttctaaatgtctgcctgtagttactacatggattatgttaccaaacatctcccttcattcaggaaagcaatctcccctatcaaacatttacgcagcacctgctcgatgcacgacattgcattaggtgctggggggattcaaagatgaattaggcacagtccttgcccgcaagcagctcacagctgagatatgctagatgagattcaattggcatctgggctctggtgaatcaatggctctcgtttgcagtggatcttattcatcacaatcatggaacatttagtgaatggtcattgagcacacacatttcataacagagactttagtcacagtgagtaatcaaagaagacaaattctattgcttttcctgccctgagccctttctctctcccagagaaagaacagctttttttcaaatgattaatagaatgcatatacaactggctgaagggtcagatgtaacagggtagcattttttggtatatcatcaagctttatgtatctggcttttgatatggattgtcatatcctccacactattgttcagtattcccctctgtctttcctctcagctcactatcatcttttatgggtgcctgcatgtactgggattataaaattcaggcaatttcaggatcattctttcttgtctcatccttgatctcacccccaagtatatttattgctgaagtgaatgatacacaactctagctccatcaggtgaaggagaatttggccagcaggagctttcctttccgagtcaagaaaattcctccacttatttagaaattaaattaatagcatgctgctatgtccaaatacagacaggatcttcatcttcttgaagcacctggttttcatctttagtcttaatttcagaggccaacctaaatctgtaaactctgtcctgtctcagtggatagtaaattccatattggatacaggagaaaaaaaacacttccctaagagcctttgagtgatctctaatggttttgctgcttttgttacaagcctactgttggtttccaatgaacataattttaatttggagtcctgctggcttgcaatctttctatgggatggctaaggcaatgccatcatgttaataacctccaaaaggccatctttctaattctcgcatgtcagggcaaaccagttgcagctcccgggaggacaactgcacttgtgctggctgctcccagggagagtcatcatgaagacaccttggagaggtgtagcagcaacaggccactctcaggccacacgtgctttacaagatgcttaaaactgaagcaaaggcacaagcctatggctaagttttgaagagcaaatgaaaaatgatataagcaatacattctttggcaccaccaacaaaaaagtaaataaaaatgcaactttgtgcttaacataatacaggaatttagttgtttatcctctccctcaatttcaaacactatgcacaccattcattacccttttaagataatgtgaaactgtcctttttgaaggctattgggagtcaggaaagtcagtcttcagtagggaattttataatgaactatagaagatccgcatcaaatcaaaacaaaacaacaaaaaactcacacagaaacaacaaaacaaaacaaaacacacacacacatgcacagaaaaccccatagctaacatctagtccagaagtttgattatatagatgaattttcagagaggttaaattaattaatcaaacaagtggtaaaacgaggcttggaacccaggttttctgatggctaattccacattctttccactgccaccattttgtcttgaattttctttaaagcttacttgaaaatggatatgcttcaagtgcctgtctaatctatgctggctattctaaaagctgatgtggtcctgcagagaccagacacctggtgactgcattacctcctatatgccttcatattttcagtgaactattcagtagggtacatttcaaaatttgcatttgcatttctattcttctgtagtcccctagtagcattcacatctctcgatattggcctctgttctctcttctgcttttgaaagcaaaaattacccagcaaaataacaggaattgcctctcacatgctgaagcttatttgacaggagggatttggctgacttgagcatcccgcttggcattcagggatgctgcactgcctggggatgaaggaggaatgaatctgagccagactcgctaactcccattagggactccgacctcttgcccaggacaatggtaacgttgacaactaaagtccattatagtgaaggggatttaaatcatagtctaattctcattaagagtgtatgccaaattatcaggatcttaacactaaggtcatcatttttgtagaaataacaaaatcttgtcaatctggataaacctaaacaacctcaactttgatgaagaactacactaatgcagataaaattctaggttattctagtaaaatcttctggcttctgattggtgtattagcgaccagagctaagaaagtaatagtcctgctttaggttctattgattagacgaaatctagagtgcctgtgttcattgcagccaccacaccttaagaggaatattgagaattgaagtgtatcagacagaaaggaccaggctaatgttacagtgtgaaatgtcatcagagcaattaatgaaggcctgggtgggcttgagcctagaagataccactagaagaaccagaagagctctttcttcacggatctgaagatcgattaaatttgctctctacggccctagtcaaatccaaaagtaccagaaggaagttacaaagcagcacatcttggtttagtgcaaaaaaagaacattgtggtaggaaaatggcacaagcaatacgttctctgacagtgaagacaaacaaggggaagcccaagtgtgatgttgtgaacaggaatctagcatttaatgaaagactaggctagatgattctagtgcagtgtgtttcatggaacattactgccgtaagattattcagtacaaaggatgggtggcaagataaatatgtttgggaaatatacacattgtgtttattcctcgagatgcatgattcatattaaaagcagtaagtaaattcatttaatttagcttaatccaggtttttctaaatacatttggctgctgcctctgccacatttttaaagtaatttttgtttctaccctttgaacacctagtgggaatactttcccatagatctcttcctatcctgagatttttttgtatcaagaaatcctgaattctttaaaacagacctggctttgatgcgatggcagcactgcttgatattttactgtttccaggaatgagagtgttactttaggcctctgtgcttgatataggggggctggtgtatatgatttgagatcaatgtgatggtcgggattgattttaaagagaggtaatggaagtcacgcagagggtgatggtaaggaagagcctaaggctgtaatcactgatgtgtttgagggaatctccgcatgtgacgtggctagcaagtcctcctcacttgttaactgtgtctctttgcaagctcctaagaggtgtcccaattcccaggaaggtacattattttcagggaaagaggacacacaccatgtctccaggtgctgaggcaggggttgtcatgatggaggtggcatcattttatggttttacttttagctaggtcttctctttcatactttcattaaagaaaatgacaagcaaacccctatttttctgtaatttttgaaatgcagagtgtcacatttagatacagcaagagatagaagtgtggggggttctcaaaaagagagaagtaggaggtggggctccttgagttgtttttggtgcaggagccatggccagcatgccacatgtgaaggaagaagagtgagcagcagtttgtaatgcacaggggaagcaagggtgtgatgccgtaagatgggagggaaggagtgtcttgaatgtcagaacgcaacaggatttgtccaatttggctgggagaggggcagtggggtaaaatgttcagtgtgtcagagaaaggtaattctgaacattaggtagccaagagtaggttaaggagggaagccgtgccaggactatagcagtaggtaatgcacccttttcgcaaagacagcattggctctcagggctaagctcagagagactgtcagtgggttcatttattcaacagtgactcagctggagaaataccacctggggcggccagatcgtgtcccttattctagcaggagtgagggctgctattgtgtgagtgtgactaaaccggaagttagggagggagcacgctgattgcccgatggattatgacgaatggagagggcactcaccctacaccacataagtgggtgggagtggagagtctgcagcgcaccttgtcaatgtgtttcctcgcagggtttaatctttcatcataaaggctattagggatttcatcacaggctgctctggcaattagttcagaataaactgagaaaactgcagggactttgcggaggagacttcagcctttgcatttatagcgctttttttaaagtaaaataatgactgtgtttaaattgtacagagatatttataaaagggataaaattttaggctattttgggaagatgtggtacaggagaagagaagggagaaacccacaagccaccctgtgtcaggcctcttttttcccatttgtaaagtgattgaattttattttaagtatccatgattggtattaaatccattacagtgctaggtagacagctgaaaagaaattaatggaatctttagatgttggtaaaatgtaattctaatgctcattgtgttgaagtaaataacctggttgtgaatagtttagaaccttctctaaccctagagaaaaaaagttccctctcactcccagggttgaaaacgccccctctgagagtcaaattgtgtggttctatctctgatctcaggcagaaggaaattgcaatataaggcttggctctgtttcagtaggccatgttgcctgataaggttaattgatttccattgctttaattaacaaaattaattttttatctaatgagggagatttgggagtgacatgggtagatggaaagatgacaagtgtcagccccatagttaaagagtgacgtaggccctgtgaggatgggcaacacaaagaacccccgagtcacggagtgattaggggcgggtgactacaccatgagcatgccacttctctctctcttaagaccatcctgaaccttgctggagagaacttggactttgttactctcttgtaatggtggctttcagaaatccatcatggtgtgtcacagtggctcatgcctgtaatcccagtgatttgggaggcccagctgggaggattgtttgaggctaggaggtcaaggccagcctgggtgaaactccatctctataaaaatttaaaaaatgtagggagatgttcaaaggttgcagcgagctatgattgtgccactgcactgcagtgtgggtgttaaagcaagaccctgtttccaaagaaaagaaatctatcacctcttcctcatgagtctccaaaatgagtaattctcagcaaagtctccatgaaggcctaaggtaccatgagagtctgctccagaccaaatttagctccaggttcttgctccctctatgtcccaaacggccttctcggaagccagcattgtcctgagcctgggccagctcagctgcaggagactccacctgagtcttctgtttttgcaaacacagggcaggagactggagctgtccgctgcctgtagactgccactcttcgccctccctcttcacacgcttcactagtcacacatattccacccaacctccgcacgggtccctctggagggatgacttgcagcccgccttgtttatgtgtctggcatcagtaggcggcagggagatttgctcctcatcactttgatcaatctttctgctgttgaagcctctcaatgagttgaaagtgattttccctgctctatgtacaggtaggagcagatcgccttcgatttctagtacagagacagcggcactctatcaagttgttgcgttgcataaccatgagtgcggggcgcggtgtttcctgtgctcatggagtgatggtcatgcttggcattgtgatccatcttagccctgtttgctagtgtgctttacgtcaaaagcacagctatttctagtgtgttagttctcttccccctgggagtctctgaaagatggaggcctctagggatggttgaaaggagcactgcaaaactgccatgattagttctgatgactgaggaagctaatgcctagccgggagatatcacatggaagcctcaaagctgtcttcctgcctcccctagaaacacattttgctttctccctaaacagagttcagacaacttctgtcgagtcctcctctgtgggactcaagaaagagtgctgttccttcaggctcgatgttattaattcctggttccgattcacaggagtaatgctgcaaaggcttttttttttccccaaaatggagtcttattctttcgcccaggctggagtgcaatggcgcgatctcggctcactgcaacctccacctcccaagttcaagctattctcctgcctcagcctcccgagtagctgggattacaggtgccaccactaagcccggctaatttttgtagttttagtagagatggggttttgccatgttggccagggtggtcttgaactcctgacctcaggtgatccacctgccttggcctcccaaagtgctgggattacaggcgtgagccactgtgccaggccaactgctgcaaaagcattttaagggagactgatttctcttcctcctgcaaaacaaaaggaaacattttgggattgcctacaagcatgcacccaggcaaatcttcctgtagggtattcagctgagcattgtgttttcaccttgacttcatgggtggagggaaaacagcatcacccaagggcacctgaaagtcagtcaaagggtaggagctcctgcatcacttgtccatgtcaaggcgactcaaggaaacttagaaatgtccaggaataagttgtctatctggtcgaggcacctcatttgacacatgagaaggctgagactcacagaaattaagtcctattttgaagttccagagtttgctaatattgaactggaattagatcaagaccttttttcattttttgttcattagaattcacccatatgcttaacattttttggttgactatttattgagcacccatgatgtacaggcaggcagggttctaggtatgggggattcaggaatgaatggaattgacagagtcccacaagaagctcgcagctgggtgtgtgcatgaggacagagctatgagttaataaatacacacctagtgtcaggtatctgtgctgtgaagaagaagagaagaagggggataggcagtgatgggagtgctaatttgcaggaagtgtcagggtcgcatctttttaacactggtattcaacagagacaggcaagaaggagaacaggagctatgtggcccttgcagagaagactattcttgatagagggagcagcaattacaaaagcctttaatttcattatttttcccccttcgtcacagaaacaggtgcttaggaattatacattttcttatacatacacttaagcctctctctacctagcacacacacacacacatacacattcttaattcacgggctaaagtagttataccgagaatggctattaataaaaagaagaggtagagggaaatgtaaaagctcttacacacacacacacacacacacacacacacacacacacacagagagagtcttaatttgtgggctagagtagttatatagagatcagctattaatataaagaacaggtagagggaaatatacaagcttttatacacacacacggtgttaatttgtgggctagaatagttatatagggatcagctattaataaaaagaggaggtggggaaaagtacaggcttgaaagactgtagatgaattcaaggtggaacagtcttttgagtctaccactttgccatcgattccacacctactctaagatgaataggctggtgttgaaactgggaagtgcatttctaatcacaactggtcagcattccactgcatactgccggattacccggagagtcaaaggacactctttggagcctggaagttgattccaaggttctatttcttgtacactcagagaccagtgccttcagacaaggcccaggggcagcagggtcagaggtgatgtcctactgcaatccacagagttctcactgccatgtagacaaaggcagcatttagtggcacagctgcatattcttcagagttagaaaaggaaacattttttttctagatacaaatggggcaccaaagattccagaaagcagagatgcatggtttgagtcagtgtggtgtggcactaaaggcacaggagactatggccaacttgttcattttcttttacaggatttttgtgagacttgggggttgcgatgttctcaggagccatgtactatgctgatctaattcaattgggcttttgttatgttctgagtattggcaagattctacgagggctacaaaataaaattacacttttgtctctctgaaatgactcatagtctttcataacaaggtaggtcatggacctagaacaacaggagcccagcacacagtgatgtgtgattatgtgccatgaggtccaggagacaagggtaggcttggccctctagagaccactgcagagcagcgggctggacttcagccggcttttgaggagtggctaagattcaaagaaggggaaggcagagcaggccagatggaagaaagggtaaatctgagcatcgtttgttttactagaccatgatgaggctggcctgggtagaatggaagcttccttggctcagaggaagctatagtgaaaagactgtgtttgggggaaacagtgggcagccctccctgccacgtggagaggtgagtggctaagagcatgggctatgggaacaaaccccggtttcaaatcatggctcccacactcactagctgtgtgaccttggcaaattccataacctctgagtctcaagctttttcatctttaaattggagaaggtaataacacctaattcagaaggctgttatgggaattgtgtgaattaatacaatgcaaagttataatgaaatgcctagcatatattaaagaactcaatagtcatttttattaataataaaatcatattttgctgataagagtggaagcacatcacagataaacagataatcgagtagagttgtattaatagcttaatgcgggagtaggagataaaagttgtattttgaaatgtatcctgatgctggtgtgacaggtgggtctcaccaggtgagagacaataggaacattgtcagctggacacgctcagtccttgcacctgggcagggacaacaggaacagggatgatgggaagaatctcagatttatttgagaaagaaattagcaacccctgtcttgagaaaagccagctctttgaacatctcttcccagctttaagtctcacatgtggaggatacacaggattcctcacactgctggccaggccagttcctggtgcgtgggcaaagcttttccctagcagacacactcctttccagagctatctctatcaaaccaaagattatagggatggttggggaaattccaattttctctttggcaggctagaatgaggcacctttttgagctttctctccatcatttcaacccgccctagagacttcagccctaacagagtggcaaatgttgccttctgagcctttttgtggtaagtccagtgcagagtagtctgcagcacattggctggccggaagggccagtggtgggcagtttcgctgttggccctctttataggagaggaaggcaaagctaaagctcaggaacaaggcagcagagcctcagagctggccagcacaccccctccaccttaattccctttcgtctgcagcatggtatcccagacagctgtggcacatcccttcaccccgccccagtcaatatggcatcgcccacctgggtcagtcaccagggcccaggatgatgaaacaggtgcttgcttttgtagcaagagagccagtggcgggtaagtgcctgctgtgctgtttttgatatcacctctgagatgaattaagtgtctgaggcctgcaagattgcagcactcacaggctgtcattgaaacaattgcattcaatggaagaaaacaaactccttttcctctggcagtcatcttttgattctgtagaaacaggagctaagctgatggaaaacagagaatgtaacaaagcccccttcccccataacggatgagtcagaggctttgtgagccacagggtttcttgtgttgtgcccaacacaggacggccctgtggcttccacaggtagcagggctgggcacgggagctgaaagccctcccaagcaggagacagaaaccacttggaaatgagtggtggggatcagtgtgtgagcccccaatttcagaattcagctgtaatattcatatcatcttgtactgctgtaacatcatctcctttttatttaagctcaacgtttgcaaaattctatagcaattttaagggtttctgtgcaccagatttcaccctgagttgaaacctagcccaggtattcttactttgagttctatttggaggccatttttacatggaagttttgatgaagtctgctgtaaaagtgccctggtgaggtaaggagtgagaattgatagatatgaggagtctcttcctcagaagtcaactgactgtacagtatgtaaggcttcttcccacagcagcaggtaaaggcactaaagtggttgctgacttccccagatagctcagaaatccacaaaaaggggcaagagctgaggccacctgagcttgcagtctctgttgttactggccctgcagcggatcctgcgagacttccatggaagtccgtggttccccaggcaactgggcgattgttcctcctgccttgcaagaccagacatctgttgactgcatattgatcaatagcagcactgtaggtgagtgggccagtgggtggtagtatttagagactaagggagtctctgtctctaagctttacagagaggtctgcacaggtgacaggtgttcagagattctctcaaaatggtggctgactccttggcatctcttgccttaggaaaagaaacagaattactgacatttcatgtcttgcttatcatatctaaatagcatagacttaccccaactatttttactgtcataaaacatctttccagggcatgaggggttgcgcgcttctcttttgcctctaagataagatgctgtgcctgtgtgaggccattctgcattttatattcatttggttctttgctgcccttgcaaatttaacagccttcaaaattggatgcttctcactggttctataatgaagtagcaatttgtctccacatcagaatccaggtatagctgtgctaacttgaagcctgcccttgagcttctggagaatgttaaatatttccatctgtagaaaatccctgggtatcacaaaaatggggaggaagaagtcctcattcttttcataacaaatgggggtgtaaggaagtaaggaaagagagatgctaagagcaaggacattcactaaaagtagaacctctgatagcaacagcaatctgcccatcctttttattcctctcactccaagtgaaatgctcagttgaggctgggggaaattgatttcttttaaactaacactgaatgaatttctattgtatttcaggcactgggacatttctatttcttgtctcatttaaatttctcaatcctataaaagggattctatattgacttccatcttaaaagcaatgctactatgtcttagagacattatatatcaatggcaatacacttattcaatatacaaactttaacctagatttgtctggtcctagattccaaattcttagccactagatcctactacttgagtttgtcttttttttttcccattagtggaatctataattctgtgagacccaaagaggctaaagtgttttcctaaaacctgtttggctcctggcctctgagtctcatacctagtggatctccttcatttatcccccagatcccaagaccaacgctgctctgagacagaagggattagtattaccagttcttgtcctgcacgctgtgagctctgtatcatgcggccttcacttttttacataactttgattgggtaccttggccatgagacagccctcacctttgttctgaagtccacttctttaatgatattgattccatttcctaacctggccctctagtttcatcctgggataggcatcctggcatgctttattggttcctcctttcaggaattggactctacatgtggctgtgtcctgctacttgcaaacagagcccctagatggagactcctttctttcaggactcccatcactgttgttctctgtggttggtaggacaccctgagcctgcagtgaacaactcctacaaccagcttcctgcttggacctcaacgggttatcagtttgattcttgggagctacacttgccagtagcctgcacctcctctcttaatccatacagctgggtcagttttgctgcatcctcgcccggttaattgtccaagacacactgtcttaaggagatttggaatgagagtgaggatgatgtcaaagacttggaggaggcgattccagtgttgaattaactgtttttctgattgaaagtcaacttatcctctagtccagaggccatcattgaaaacaattttagggaggctgaggatgctttccctcctttaatctatgtaatatcatagcccaccgagtttgcctacaccagcagcagcctcaccaggagaggcgctgacttcatggatgcagcctccaggggtgacgcagtccagggcccacactgtaaattgaagtccgccttgtcttgttctgaagacaatctgccggccacttgtcaggtacgaagtgctgacatgtgttgaaatgagaactggatttggagttaggaaatctagtcacctggaccattctgccattctgtatgactttggggaaatcacagcctttcagcctgagcttcctttattataaaatgaagagtaagaacggcagccttgcccatcatgaaagatggttgtaaggattaaagctgaggttctcaaccagaggtgattttgttgccaaggggacattttacaatgtctgaaagggagttgctaatgacatgtagagagcaaagttcagggctgtggctaaacacaggcatgggacagcccccggcaaagtagccagcccaacatgtcaacagttcaagttgaaacatgcatccatttaatgtgtttcagatttagggtccagccacagactgagctctgcttccatggagcgcaccagtaggtaagagcagagacagcacatcatcaatgggcttattcctgttgcccctctcatgccctacccaaaggccgccccagactggccaatggcctctacaaaccctctcccatggagatccagaagattgcaagttaatcctcaccaaagtccattgattatggggctcttggctctcactcactggtacactctatgggagcagggctcggtctgcttgttctggaccctaacatctgaaaagaggccaatgggttaaagtgttttttccttttaaaaaaactttcattttaggtttggaagtccatgtgaaggtttgttacaaagataaacacatgtcatgggggttgttgtacatattattacatcacccaggtgttaagctcagtacccaatagttatcttttcttttcctctccttcctcccaccctccccatcaagtagaccccagtgtctgctgtttccttctttttgttcatgagttctcatcatttagctctcactataagtgagaacatgctgtatttgattttctgttcctgagttagtttgctaaggatgatagcctccagctttatccatgttcctgcaaaagacatgatcttgttcttttttttcactgctgcataatattccatggtgtatatgtaccacattttctttatccgtatctgtcattgatgggcatttaggttgattccacgtctttgctgtttgaagagtgctgcaatgaatatttgtgtgcatgtgtctttattgtagaatgctttatattcctctgggtatatacccagtaatgggattgctgggttgaatggtagttctgcttttaggtctttgaagaatcactgtactgctttccacaacagttgaactaatttatattcccactaacagtgtgtaagggttcccttttctccacaacctcaccagcatctgttattttttaacttattataaacagccattctgactggtgtgaaatagtatctcactgtggttttgatttgcatttctctaatgatcagtgatattgaactttttttttaaatgcttgttggacacatatatgtcttcttttgagaagtgtctgttcatgtcctttgcccacttttcaatggggttttttgtttttctcttgtaaatttgtttaagttccttatagatgctggatactagacctttatcagatgcatagtttgcaaatatgttctccctttctgtaggttttctgtttactctgttgatagtttctttcgctgcacagcagctcttaagtttaattagatcccatttgtcaatttttgctttgttgcaattgactttgatgtctttatcatgaaatctttgctcattcctgtctaggatggcattgcctaagttatcttccagagtttttatagttttgggtttacatgtaagcctttaattcatcttgagttgatttttgtgtagcgtgtaaggaagcggtccagcttcaatcttctgcatatggctagctagttatcttagcaccatttactgaatagggagttttttttttcccattgcttgtttttgtcagctttgttaaaaatcagatggttgtgttatgcctgtaatcccagcactatgggaggccaaggtggatggatcacctgaggttaggagtttgagaccagcctgggcaacatggtgaaacccagtctctactaaaaatacaaaaatgtactgggcatggtggtgggtgcctgtaatcccagctgcttgggaggctgaggcagaagagtcgcttgaacctgggaggcagaggttgcagtgtgctgagatcacaccattgcactccaacccgggtaacaaaacgagactctgtctcaagatactactactactactactactactagtactactactactactaaaagattagatagttgtggatatgctgctttacttctgggctttctattctgttccattggtctgtgtgcctgtttttgtaccagtagcatgctgtttgcgtcactgtagtcttgtagtatcgtttgaagtcgggtaacatgattccttagttttgttctcaataaaatacttgcaaaccaaatccagcaacacattaaaaagcaaatccaccatgatcaagtagacttcatccccgcaggcaaggttggttcaacatatgaaaactaatcaatgtgattcatcagataaacagaactaaaaacaaaaaccacatgactatttcagtagatacataaaaggctttttcccatttattttaacataaagtttttaacttcatgttaaaaactttcaataaagtaggtattaaagaaacagacctcaaaataataagagccatctatgacatacccacagccaacattttactgaatgggcaaaagctggaagcattgcccttgaaaaccattacaagacaagaatgccctctctcaccacttctattctctcaccacttctattcaacatagtatgggaagtgctagccaaatcattcaggcaagagaaagaaataaagggcatccaaataggaagagagaaactcaaactatctctgttccagatgacatcattctctagctagaaaaccccatagccagctgaagctccttcagctggttaaaaacatcagcaaagttgcaggatacaaaatcaatgtgcaaaaattactggcattcctgtacaccaccaacaaccaaactgagagccaaatcagaaaggcaatctcattcacaattgccacacacataaaataaaataactagaaatatggctaactagggagatgataggtctctacaatgagaattacaaaaccttgctcaaagaaatcagagaagacacagatggaaatcatcccatgctcatggataggaagaatcattatcgttcaaatgactatactttccaaagcaatttacagattctatgctactcctatcaaactacgaatgacactcttcacaaaaactagaaaaaaatattttaaaatttatatggaaccaaaaaagagcccaaatagccaaggcaatcctaagcaaaaagaaatttttttaatggaaaaagtagccaccatggccatactttctgtaggtttttataaatgtaaatcaaatacaggaaaaatttagaaaataagtaaaggaaagatggcctatgtgcaataatggaaaggtagaaggataagatgtgattaatgttttacaaatgctaaaatttcaaatagaaataaagtagaattttgaaataatagaggttgagttataataaaggtaaaaggtcaagagttagaaaatagtatgtaattgacaagtcttaaagccaatgattaagagacaaggctaaacccacagcataaactaaacatttagaaacaatagtgatactttttaaaaaagagtgttttttgtttttgttttgttagtacttgaaaattaaaaataatgagaaagaaataagaaaactccagttagaagtaaaggctgtaactaaagccacggtggctctgatccccctgtggtctctgtggaaatggcgacactcctccagagtagagaggactggggtgggagcctacattgcatgattgatgtcagctgtccttgtcacccatactggtaaggatctaagacatgggtcaagtcacagcccacagccaattcttcctccttttgcaacttaccagcttaccaggccagcaggcaagtggggtttggtttcagttctgactctacggggccactccttgcagggtctgctgctttcatctcacctgctcgttcttgaactttctataataatagagcaacacaaaggctcatgagtgaccaaatccctttctcttccagttttactcctggatcctcactttatctacaccaattgtattggaaagcagatagagggacaccctttgtaataacttggacttgggttcaaatcatgactttgcccactattagctgtgtaactattaaacaattttattaacttctttgaacttcggttgtctcatacaacaaaggaggaaaatataaataagtttacccctcttaattgtgcaaatgagaacatttttttaaattttattattattatactttaagttttagggtacatgtgcacaacgtgcaggtttgttacatatgtatacatgtgccatgttggtgtgctgcacccattaactcgtcatttagcattaggtatatctcctatgctatccttccgccctccccccaccccacaacagtccctggtgtgtgatgttccccttcctgtgtccatgtgttctcattgttcaattcccacctatgagtgagaacatctggtgtttggttttttgtccctgcaatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatacacccagtaataggatggctgggtcaaatggtatttctagttctagatccctgaggaatcgccacactgacttccacattggttgaactagtttacagtcccaccaacagtgtaaaagtgttcctatttctccacatcctctccagcacctgttgtttcctgactttttaatgatcaccattctaagtggtgtgagatggtatctcattgtggttttgacttgcatttctctgatggccagtgatgatgagcattttttcatgtgttgttttggctgcataaatgtcttcttttgagaagtgtctgttcatatcctttgcccactttttgatggggttgtttgtttttttcttgtaaacttgagttcattgtagattctggatattagccctttgtcagatgagtaggttgcaaaaattttctcccattctgtaggttgcctgttcactctgatggtagtttcttttgctgtgcagaagctctttagtttaattagatctcatttgtcaattttagcttttgttgccattgcttttggtgttttagacatgaagtccttgcccatgcctatgtcctgaatggtattgcctaggttttcttctaggttttttatggttttaggtctaacatttaagtctttaatccatcttgaattaatttttgtataaggtgtaaggaagggatccagtttcagctttctacatatggctagccagttttctcagaaccatttattaaataggtaatcctttccccattcattgcttgtttttgtcaggtttgtcaaagatcagatggttgtagatatgcggcattatttctgaggactctgttctgttccattggtctatatctctgttttggtaacagtaccatgctgttttggttactgtagcctcatagtatagtttgaagtcaggtagcgtgatgcctccagctttgttcttttggcttaggattgacttggcaatgtgggctcttttttggtgccatatgaactttaaagtagttttttccaattctgtgaagatagtcattggtagcttgatggggatggcattgaatctataaattaccttgggcagtatggccattctcacgatattgattctccctacccatgagcgtggaatgttcttccatttgtttgtatcctcttttatttccttgagcagtggtttgtagttctccttgaagaggtccttcacatcccttgtaagttggattcctagatattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggcgattttgggctgagacgatggggttttctagatatacaatcatgtcgtctgcaaacagggacaatttgacttcctcttttcctaattgaataccctttatttccttctcctgcctgattgccctggccagaacttccgacactatgttgaataggagaggtgagagagggcatccctgtcttgtgccagttttcaaagggaatgcttccagtttttgcccattcagtatgatattggctgtgggtttgtcatagatagctcttattattttgagatatgtcccatcaaaacattttttagattgtgagctagtcgaggataggggccgtttcttatttgcctttgtgtcctcaatatttagtaaagtgcccagcacttggtaactgctgtatgcttttctaatgataatgatgaaaactgaggttttgagtattgcattactatatgccaggaattgtgctatgcattttactctgattatatcaattaatctttaaggctgggcacagtggctcatgcctgtaatcccagcccattgggaggccgaggcaggtggatcacctgaggtcaggagttcgagaccacgctggccaacatggcaaaaccccatctctactaaaaatgcaaaaatcagctgggcatgatggcaggcacctgtaatcccagctacttgggaggctgaggcaggagaatcgcttgaccttggaaggcggaggttgcagtgagccgagatcatgtcactgcactccagcctgggtgacagagcaagacttcatctcaaaaaaaaaaaaaaaaaattaaaacacacccacaaggtttataatatcattattctgttttatagatgaggcatagaagtaatttgcccaaggtcacctagctagttttcagtttttagccgtcttttaatgagtgcctaggtttttagtaagcataggagttaagaaagtcaaacggaaactgaagaatatctaaaatagccaccaaacccgtatagtgttctctgcagctttgtctctgaatacctccaagtgtcttctcaaaactcatatttacagtgcgagcaccttgtcagtttgatcagaaccctggtgcacatgattccaggcttaggtggactcccctttacttggcctccgagtagtagctgtacccagggtccccgaactctgctgcaaccccaacataccagggaacattgaacagtcattctatgtctctgcctatcaaaggaagtggaggcttcagtgctgctcagagaatctggcaattatgaaagtttaggtctatagaattccatgtatctatgttggtccttaaacagaagttaggtagataacctgattgagagaagaagggaaaatgagcataaactaaagagatgggcagatagccttaaggaggggcagatttatcgaagcttgagatctgctgtttcagagaatccaatgctaattccacgatttttttctgttacctccctgtctaggaatctgaccctagagaattacctcgagcagttgacactccagatggatatataaggccacactatctctgcaatgagcgtaaatacactgaaacacaagcagtaatcctagagtctgcacaaaaacctggtgccaaaatatacaaatggatccttctagtacatcctggacatttaggaaaaacacttcctaacccctcacctgctaacaactcacacaccacatatcccccgcccacatacacacatacccacataccccctcatacacacaccccacccacatcccacacacactacacacacccacacccacatacacacactcaccctccccacacacccacaccctccccccacatacacacaccaccacataccccatctcgtgcacacatcccacccacaccccacacacacatacacgcacccacacccacatacacacaccctccccatacacccacaccccctcacccacatacacacaccaccacataccccacctcatacacacaccccacccacgccccacacacacactcgccgccccacacaccctcacccacacctccctcacttatacaccccccacacccacacgtcactacacaatatacacacaatcatacacccacaacccccacccacaaatgtacacacacccacaccccacatccacatccacacactcactgccccacacaccctcacctacacctcccccacttatataccccctacacccacaccccactacacaatatacacacccatactcacacccccacccccacccacacacatacacccacactccccaacacccacatacacccacccacactctgtacacacatatacccacaacccaacacccacatacacacaccgacaccccacacacacatatacccacacccactccccccacacacttacacatacccacactcccacacatacacacacccacaccccctcatacacatacacacacaccccacacacacatacacacacatacacgcacccacacacatgcatatccacacccactgtttccacacacttatacatacccacacccccaaacacatacacccccacccccacacacacatacacacacccactccccccacacacttatacatacccacacccccacacacacccacacccccacacacatacacacaccccacatacacacacccacactcctcatcttctcttcttcttgtttcccacacaaaggagaggcaaaatcgggtggaataaagctctcaattgtttttggagggaaagaggactcagttatgaactgacaagaaaataaagcagcaagaaaaacaggttcaggattgcactcagttttgctgagaaaaacaggaaaagatgagcaagaaatgaggcttaattttaatgaaggaaaatttgctgctaagtaaagagattgcaggaagtgggagtgcacagcttcagacaagagcaaggccttccgttctattgtgatggacaagagtttgttctttaggaaacagcattagcacacaaaagactgaagaggacaaaatgcttgaggtggagtccagaacagagggccgcattgcaggaaagaagggacccactttcttcccagatgagctctgtagaggtcgattaaggacatgtctttctcattctctaattcctagttttctcccatatgagcactttgaacatagaaaacaggctgctcatcttggcaagtagtcatccctcctgcctagagtaacttgatcagatttcctgataatgggttcttaggacatcttaaaacgtcatcatcatttattgcctattaatagaattacaatttatatatattctaatctactaaaagtgggatatatatgtctacatatacaagcacatatatgcacaaacatatatatataatctctctgttttttggttgtttctgcattttgataggcgttaaaattacttcagtgggaatagagttttgttggagtaaaatgacaaaaggtaaattgtttccacttgctagttgaagttaacaagctagcaacaattggagtaattttgtaggtgtttgagcacataagggaggctgggaatgagcaccccaaataatgccatccggcaatctaatattttatgggtaaacgaagaggccaaaaaagaatgctttgatacatatttatgccaaatcagaacttctcgcattcgctatcagaatacagcacgtctgaagcagtgcacagtgagaatgtactgggcttttcataccagagcttccattaggaagggagtctagtgacgtggctcagcccacggggcccttcaccactgccaaggactgaggccaagaccttcgtctcccctcccctctccaggaggacaggcttcatccagagaacccagaatatagaacgtggtacttgcaaatcctcatcatagatgcagtcaaagagattcaaggatgcagagaggtacagatggagagtatataatgatactatatgtagaatatacatatatagaatatatctataatactatatactattctgtatagctataatactatagctctaattctatatatagaacatatatctacacacacacatatgaatatatatttatacatctctacactaaaattagattctctgtgggcaagaaagtattggcattgatgtccttttgaagaataaaacattctcagcctctttcaaatttgtgcctgattggtgacaatttagccctgcccatagcagaggaacaaggcctgcccccgctgccctgtaactgaggccggaggtcccactgccctcagagagacagcccacctggggcacagaggcccgtaggcgtcttagcagttgcttctaaaaaggattttcttccctccccagcagtatggttttatacagacccagaattccgttttttcctagacgttctagacaacttcagagagcaaagtttttcttcatcttgattccaggcctgcattcttagataattgattttttcacttgggctgagcagaggcagcatggctgtaattacagagtggtggcatgccatcccgaaaatttttttttctctttctctcagaaacttctcacatcttggatttgagcaaggtggagacaatcttttcagaccatggagcaggcagggatcagacaacatttgccatgaaaagagaaaatattctaaaagaccctcttcaaatattcagggagaaccacagaatgctgaagaaaatccttatcaggaattttaatgagcaaaataaaatatgaaatcagtgtgattaaaatcaaatcttcccccttctgcttggctggagccggctgccaactccgaatgtggggaggcacagggaggccttttgtatttaattactgccagggctttttctcagttcaaagctctctcccaagcccccacaggggtaatggagaacttgagagaacaaataacctcccttctgagtgatttagaatcctggacaacaaacaataaacattttaactgaattggagagaccaagccaacttgccttaatttgtgtccctgttgggagcacggagagggcataaatgaagtttgggggaaactgggatgtgggagcatgccccaccttaccaggatggccccttagtggccactccgttctttattttgtcccctcctttgttttctcccagaatctctttatgcatctcaagcctacaatactctgcgatacctggactgtgatattcacttctcctgcctggtggcctagtggatgcctcagcccacttggagatgggtcagttctgtcagttgcctttagctccagcttctgaactctgggcacggactgaacaccaccaatagcatgacccacaagaactgtcctcagtgctgaagcatttccttccttggtggtcaggacagctgcttttctctgggtgcctttcgggtgcttgttaatttgcaaagcctatttatatagtgtctgactcttcagttctaaccatattatttttccatttacattcagatttgtttcattccaagcagtgatttcatcacctttgtcctatgtgagggtgttttacataagcattagaattgaacagaacacaagtgggctgtggagactctccagaaatccaatcttctgcttctcagatgaggaggtgataattgatgttttgccaccagataccctcatgtggactgtgaagctggttttgctctggcacatgccttcccccagcttgtccactgtgggtaggagtgaaacaggagatggcatgagcttggaccacaggtatccagatccctgagtactagtggtggtcaacgtgctggtgggctgtttcttctccctgagattcagtctgactcgtgtcctgtaccctacacttagatatattaacagcattcttttcaatttaatgtctgttagtattaactcaattttgtatataccaggtcttgtgcaagtagatgttgaaaaatacacaattcctaattgctcagttgtttgttcattctttcaactaatatttgtcgggcagatatcatgtgtctggcaccatgctaatttccaggaaaaaagcagcagggtaggtggggagatgacagcttgaactaaaaactggacatattgagaagggttttggagatagaaccagggccttgggtggcggattggatgcgaaaatgtgtaatcaagggatactcctatattgtcagttttaacaattgggtcattggtggtagcatttatatgtcttggggaaggctgaaggctcttcctcaagtgcctaaaacccagtctttttttttgtggttgttctgatctttaatgcagtagttgaagcagtgctcagaatcaactggcatgggtttaacttattaaaaatccattggctggggcccaccccagtcttgttaattcaacttatttggatggtgggacctaagcatttgtgtttgaaaaagatcgccagacgatttgtttgcatatcccagttgaaaagaatacttctgaaaaatggcattaaaacatatgtattatgtgtttgtgtgcgggatgtgcatgtatatctgtataatccaaccatgatatgtttttaatctcacactgaggtctccagacacctacctttaattcatctctgcccaattaccatcagtcagtggctgcttagagaatgaaaccaattttaatattgatcagaacagagcatagataagtagattcaaatgctgagtaagaaagaccataggttgcagcctatggccatcagccatctttaaatgagtttgaaatcttgtatctgtattttttatttttttaaactagcagctgcctttcatttgaatgaataattgaaagttgatggcatttgttaatatgaaaccgcatgtgttgcgtgttcccacatgtgtaatcttgaatatttttcagcagaagacttctgctgttcgatactatggtttcggatattatatgcttttcaaatgccatcctgcttgaggtttgcagtcaaatacagtgatcatgaacactcatgcctactcgtatgtttgaaatagtcacgcaggtattttccatggcagccaccacctggaacccacggaatcaaactcgagtttctaataaccggttggcacttggcacatctgtctgttattatatatttcaactaaagtagggtcaatagctaatgtgcattaatatgaagtaataagacaaatgggtatttgctgcacaggcagttagaagcaatattgaaaagcctgattttatgcttttgacataacccaaattgcagtgtaacatgcctgtccagagtggcccatcctgtgaaaatgtcttttcaggcccctcaaaggcgaaatcccacccacctgtgagaagaggaaatatttaggcccacatgtgcacacacaagaggaggtctgtccccccagactcctgtacactggcagtctgatacgatctatcttttgaatacaccatccaaaccaactatgaatgaaatcaatttaaccaaaatcaatgctcttttgtagagctgcttagactctaagtggaaatgaaacctttgaagctgccctctctcagtaaatgcggtacttacggagcttctgatggcagcaggagcttgcagaatcttactctgtccagcactgcaccttcattccagaagctggagagtaactaggaaatgagtagaaaaggaatacattatgggttttgttttttttaaaaaaagtatttccttatcttaatttctaccaaatacggcatgttttattgtccccccaccttcccccaagttctggtcaccagtcttcagatacatgccctatccgtacatgaagacatggctgaggggttgttaaagtctccttaagaagaggagctgggggactccagctgtctcctgtttattgaaggagaatggctctctgttttctgccttagccaaactccacggctgataagaccacatcctcagccctcagccagctgggtgctgccgttattgtgttctgcgtattgagcagacttgcgggcccataaaacaatttccttcatggactttacatccagcagagatgttggtatgggaaaaaggagagacagcacagacccaggaaaaccatccaattctaaattgtggggtgacccatactgtttatttatacattggcaaagttggttgattgggatgtttccagagaagagcataattttaagagtttttattttaaattataaaatgcatactttaaaaggatgatagctttccaggattggcaaaaattcattagctttcttttaaatttatgaaaggggaggtggtgataagagctaacacttattagatgtttatgctgttttgagcactctgatacttgcttcatttaattttctcatttaattacaacaagaacctctgagttaggtaggttactactcttattttatgtgtgaggaatagatacttagaggagaaaacttctgaaaggcctcacgcaggataagtggcaaatttaggacccaaaaccagtttcatcagcctgacttgagttccatgggatccagaaaaaataactattattgaataggaggggcgatgggtaaggaggaagaatagacaatgaaggaaatagtacaaattctgtctttaaacagattgtctattcattcaattaaccaaatattgatcagattagaaaaattaagtgtgtcagtcaatgagtttcagtacatattagggaaaataaaatttgtatagtttcaaagacatctaaaataacgggtgaaatgagaacactactggagaggaatgcattgcttagtgacaaggacagacattgcttcaccactggcatccatcaacatcaaggacgaagcagagtcagatccagtttctacaatgcatttcctggaaaactttgaaggtttaagagtgtggtcccacaccaacctgatgcatatgccttggaaattccaaaaaattctgttttttctgaactactcaaataaattaggccaaagacttgtcagtagccaggagccacagggtcattttgtttcagtgtttcctccagggcgacctcaggagctgccagctgtaagcctgagctctcctagactggttccactgtgacactggcatctctgtgtgccttgctgtgtccgtctcttttgaactcactggatgagttaacactcagccagttaaggcttagacaggctcggacttacagccattgaagatgtggcagacgagggccgagaggagagaaagcaaaacaaggtttttattttttatgttttgcctaggtgattagaggatccagaagtgttggaattgatgctggtggtgttttaatttatgggtattcttcctttctggaagatcacagaagcgttgccactaagcgcaacaaatcccaaaccattctgagaaaagaatttgaacaaagaatttgagcctgtcgggacctcggaagaagactcttactgtctcataagggagacttaagggacagctgggtggcctgtgaactatgctgtgtgtggtcagttcagaggcagtactggggagaaaagatgctctgatttttcattcacattttccatctcacctgggtgcacaacttgactgggctgcttcaatgtcttgacttgccaacatgatgtgtcatgaatattttttaaaagacaccaaaagaacagactctttctgattggtatcctaggtgaaaatgaaatttaaaaatcttatcatcttagaccagtaaaatcactgaggttgcaagcaaaacaagtgtgaatatcgacatcaatattagctgcgtggcctcatgatttattttattttatttttattttttgagacagagtcaccctctgtcacccaggctggagtgcagtggtgtgatctcggctcactgcaacctctgtctcctgggttcaagaaatgttcctgcctcagcctcccgagtagctgggattacaggtgcccgtggctaatttttgtatttttagtagagatggggtttcaccatgttggccaggctgctctcaaactcctgacctcaagtaatctgcccaccttggtctcccaaagtgctgagattacaggcgtgaaccactgctcccagcccctcatgaatttttaggcatagagaatggagccagtaaccgctgtagcgtgctcattactgcactaaatgcgacagggtgaactagcagatatcgtcaaagaaaaaccatagctggatagtagttaatggggtaaaaacagattttatgaaggactctcacaatagggaaaaaggtctagggtagaactggctcaattccaaatatatcctggcaaatgggaatttatagcccaggaacagggtggggggtcagtggatggaaagttactaagaggaaacagcaggggtcatggcgattctaactaaacagaccaaacgagattcttgctgaagacaggccagggggaccaaacgtcatctgggggatggtggaggaggtggagcctaatcagatatccaggatgatgaggtatagagcgtgaggagttcttcgtaaactgactttgcagggttcttttctgcagctgtgttttacaaggaagtgcacagactgatgaaggagagggtctaggagcctaaataacatttagccaagcaaataatctttgctaacccagacgtgtgtatgttctgatcaacaacctgattgtcctaaaagagccagcacaaagcgtgtgatggagagtgcagaagtgctggccacaatgccagtgggacatcacagaggcaggttgtttccctgggtttttgtcgttggcaagtaacccaacctctctgtgctttagtttcctctctgtgatctggaaatcataatcattcgatctacctcctagtgtagttctgaggcataaatgctcatgaagcgcttcgatgtgggcctaataataggcaagcaatgaacagtatttaccgttacagcaaaaagctttgtagaactgtctatcaccatgagcttacaatttgaggctaacacgctaccactggtggtacacttaggtataggccacatgagaaaaatttaagaaactgaatctggaggttctgctaataagctagaagctacttgacatgctgtttgttgctgaattatctcatctggttttaagtttacatggtggagcgaggtcaggcagagccaataggcagagatacaacagcatacacagtaaatactccataaacatatgacaaatactatcactatgatactcacttctaactccgttgcgactactacgacaacaacttctgctaataaaagcaggaataaaagcatcttgcctctcagcaagtgggcccaaggaaaaggaaataaaagacaatgttttgctttgaatgaaagttaacttgtaagtttgcacaaaccagtgtttcaaaataagtcgaagtttgtgcattttatgcatcaggagaggggataaatgccctggattttatttattctgtgatagataagttttcaaattttgaaacattcctgatattctaatatgtgtttgatagcatgtttcaggttaaccagaagtatttttttctttcttagaggatcgtagaataatgatggtatagtctgtaaacaattacattttattttactttatgtattttttattttttgacatagcatctcgctctgtcacccaggctggagtgcagcagtgtgatcttggctcactgcaacctccgcctctgggttcaggtgattcttgggcctcagcctcttgagtagctgggactacaggcattcgccaccacgcccagctaatttttgtatttttagtagagatggggtttcaccatgttggccaggctgctctcaagctcctgactttaggtgatctgcccaccttggcctcccaaagtgctgggattacaggtgtgagccactgtgcctagcctaacagttacatgttagcttcagtgaaatgtaatcatgaaactgagtttgggaaaaatagccattaaacactgaaaatatatttacgtggggcttagcgatgaagtcataatttctttaatgcatcatatttcactagtgctgaatatccccgcatatataacatgcatgcagatacttatatccatacatattaacacaaacaaaaccaaaaagctagatgtttaagaccaggggttaagagtcataaacatagtttctaattcctattttatgttattattttattttactttaagttctggaatacatgtgcagaatgtgcaggtttgttacataggtatacatgtgccatggtggtttgctgcacccatcaacccatcatccgggttttaagccccgcatgcattaggtatttgtcctaatgctctccctcccctgacacgccccactgtgtgatgttcccctccctgtgtccatgtgttctcattcttcaactcccacttatgagtgaggacatgtggtatttggttctaattcctattttattagcctgggaacagaataaaaaggggctggtgcctacattctttctgtgaatatctagattgttcctgcttggttctttgtatggttgagaatattcttgttgcttctccgactttacctcttaccatcctcctccccttctgcttcaaccacctcagtcttgttcctatctgagcatacagaatgtgccctggccttacaagcctgactctggtctcctcttcctggaatgctcctctccagatactcacattttcactgtctgcctataattcctaccaggcctccttactctcctactaattttttctcatttagcatttcttactatctggagatgagatgactttgctcatttgtcttgcctattcaatgagggctcaacagaggcaagaaatctcaaatgtgttgttcttgctgctgcaccccaaaaccttgagtagtacccaccacagagcagaaactcacaacatttgtcgaattagttcactgatgatgaaggtattgattttgtggctatatataatatagagcaaggtgaagagggacatgaattcttttttttccctgggatggagttttgctcttgtctcccaggctggagtgtggtggcatgatcttggctcactgcaacttctgcctcctgggttcaagcaattcttgtgcctcagcctcccaagtagctggaactacaagcacgtgccactatgccgggctaattttgtatttttagtagagacagggattcaccatgttgaccaggctggtcttaaactcttgacctcaagtaatccacccgctttggccttccaaagtgctgggattataggcgtgagccaccacacccagcctgaaatggttttaatgtgcttattctagcaatggcctcaaatgtgaatttcatcttgaggtgactttggaaagaaagagattttctagtttagtgctagtagtggttttcctaagtgtcaattcaacatatagaccagcatttccaccccagaaataaagagtcctctcagtggtcaaggcgattttataagcaaatgagtttgcggcactcaagttaatgtaatatcacaagaataatatgtccaattaaattttattgtcattagattccactttaaaaagtgcacatgctttaaattttcatattttacaaaaggaaaagtagatacatggcttttctggacctgtctgaaagcctcatttttaaggttaagaaaatactaagttccagagaaatgtataataagagacatgcatctaattcaatgaatttgcaaacctcctcattttaccttatttagttaggttttacatggttcagtttttaattctacccaatacacgtggtttctcttctaacacacacacacgcacacacactgaggtgtggttttcaaggtcctatcatgtttagcaaatatttcggatgaaacgatatgttcatctgttacgctgattgccaagattacagcacgacaacaaacattatttgggggatagaagctaaaattacagcccactctctctgccgtctgcagtgatgaacagatgcacgttaattttttgcggcaatgtccattgcttgggagccgtgggcacatggagccttagcgtcctggccaggcgtgcctgatggttctgtgggggagaccattgagtcgagggctgctgataaagtcaacatcagggcctcttcctagaaaggctgcagcaataagtgtgtgggaaagacatgaatatggtaggaaatgatggcagcgtggactgtgtttttcttttctttcttttttttttttttcttattatggaaggcagcatggaaaacatagcagaggaaggttttggctgtagagatgaatagtgtgcagaagccaatccatggttctggggcaaaaaaatatccacagaagtttcaagattttcgtataagcacatgtagaaagggagaaatgtttacaattggttccaagtttcaaattgtctaattttgacatgaagtttagaaggatgtttagaaggttctgtagtgtattgaatttaattagtttttaaaatgtgagctagtttagctagtttcttataatgtctgaaatctttttttttttttttttttttttttttttgagacggagtctcgctgtagcccaggctggagtgcagtggcgcgatctcggctcactgcaagctccgactcctgggttcacgccattctcctgcctcagcctcccaagtagctgggactacaggcgcccgccactacgcccggctaattttttgtatttttagtagagacgaggtttcaccgtgttagccgggatggtctcgatctcctgacctcgtgatccgcccgcctcggcctcccaaagtgctgggattacaggcgtgagccactgcgcccagcctgaaatcgtattcttatagcaaataaataatggacttcttcaaactgatagttctctctgtaccattatattagttttctatcatcgctgtcacaaatcaacacaacctgagtggtttaaaacaacataaatgttttctcttacagttttatagcacagaaatctaactcgggtctccatgggctaaaatcagggtgtcggtaggatggtgtgtgtttctgggactctaggagaagatccatttccttgtcttttcagcttctaaaggccacctgcattccctggctcctggcctcttctctcatatccaaagccaatattatagtatctcttgggccccgcttcaggtgtcacatcactttcttgaccacagcctggaaatgttccaggatgctcttaagaacccttgtgaataaatgggactcgtggaatagtccagcataatctttccatcacaaggtctttcatttaattgcatctgcaaaaatcccttttgccatgtaaagtaatgcattcacaggttcttggaagtgagggacattattccatctaccaaaactatgtaagaccgaagtgatgttgagtggaatctgcctctatgatttgcagtctatttatttgtgaacagttagtgtttaaagataacacctttggagtcaggcagatttcagttcaaatcctgaatatgtcattcattcatttatcaaatacatattgactgaatgcctattatgtgctaagctttgttctgatcaccgggaatattacattgaataagacaaatttgctgctccgtgcatttatatggcgatggggatgcagaccgcatataaataaagaagtatatcatgtactatcagatagtgataaataccataaagataaacggtagtgcaggcttatgctgtccatgcacggaagtcactatgtcactctagctatgtgtataatcactcattcatttattgattcatttatgttaccatcaaacttgtctttgggacacttatggtgaataggacattatgaaagcattttaatataccgcctatcctttaatcatcagtataaatctatgagattttttttccaactttgaggataagaaaactgaggcttaaagaagttaaatgactgtttatattactttttatcatgtggcaggcaattaaatgacagagttttagaatgtcattaaacttgaactttttaaaaaactctattttttagctaagcaggtggtgaaccccttgcaagtagtagaagggaaagtaaagcttgggttggggcttcaagccctttagtattcaatcttgagacaatacactttctttgagcctccactaattttcttttgatcattatggggctattctgtctttgatcaatcatttatatctgtgtttacacaggctgagcaaagggaagagttagacaattacccctgccttggaactaattcaaacagcctattcagggctacggctcatcttctctgatttcattctcactgctcaggtacagatgctgagtacacacaggctgggtgaaacgaaggagaggagcaagatcagagaatccgtgcgaaacaagtctcacaatgcggtgttttgttgttgctgttgatgatgtcctttgtgatagtagtgatggtggatattctttcttttggggggaagcatatttgtttcttttggttgattagaggagcttcactggctgtgtacatttatcacttgaatgcatttgtcataacatatttggagagaattcggatataaatgaattctcaatctctacagaggaaaagtattcagcagatgagcctccaaatgactgtcatctttaatatctatttgattatgtatatattttatgtttaaactgtgactattttttcctggctttcctggacagaggtcgatttgccagctcagcttgacataagcactgggactcattctgcagcagagtgaataaagcccctgcagtgaatgatgggcctcaacatcaagtctgttccatatctcccctactctggctgtggccccagctcttggtggagaagcactgtgacacttctgtcagaaatgcccagctgtaacactgtcctcatagcttgtctccttgtgtccacgcctgaatgtctactttaataatttctctatgccccagtttccccaaacctgggccttgactttgacttgctctcagacaatggactcctgcccacagtgtgggcccttctatctgctgctaggccacattcactcctgtgggtggccagcctgccccattccatcttagcttcccaaattgcttgaaatttctctttcttgatccctctgaatcatacattttttagaacactacgtcctgtcttcctatttagagtttatttcttctcctacagctggatttgacccaaacaccccatcccattgtacctgagcttctgtttgaacaccagctgagcattttgcttttagaatcctaagacctcaccactaatgatgcagttttgatgcctaaaatcactagaaagtctgggccaaattctcagtgctttcaacaaactggaggaaaagctgttatgttgcataacaagaagaataagtgtgttctgcatctcttcttctgaactcacatcttttgccctcctagtaaaccacctctcttccctaatttctacccctagaagagcttcaaggaaaatgccaataaacatgaagataatgaattagaaatccaaagcaatgctttaaaatgatgtttttccctgaagtgttggcatgagaaaagaaagctgaaaggtggtgaggggagtaactaacacaacagtgatgaaacaggattctgagtacaatatcctactaaatgacacacataaggagttggagctttgtaataccttttatattgctgcctgccatctggttggcaattgttaagcctaaaatattcaggtaagctctattttctcaaatagtgcaatgttatggggatttcagcagccactcatcttttaaaatatcattatatttcactgttttccagaacaaagcaaagtatgttagcagaatatttgcatagcacgcagtgttacctggaagtgctgggtagcacaaggcaggaactccacattgtgtgaggacttgtaggtgagagtgagatgctgttttctatttgagccaggatttcaggctgaggattctcacttaaggtgggttgactcattccacctgaaccctgggtgggaacagtccttccagggaaggatagtgcttgggcatttagcaataattataaaaggggactgaagtgagcccctctttgttctggaaacggcctgctgggaaagtacagggcccaaaaaagcattttccacattaaaaagaaaataagactgttgatgattttaccattctctaagaaatggtgaggggaatatatatcacctgaccttatgccataaagtataacttgctttgaggtatccattctgccaattacctagatttttaaactaagggaaatgccttttaaataaaatctgagattcaagcatcatgagctgagctgacagactgaaatatgcatagagagagactgaaacttccatataatccccacgtccaaggagagagattcatttcttcattaatttgtgcatgcaaacatatgttcagtacacatttatgggcccatgtcattttccaggcaaatactaagttgtatcactacaaaaatgagtaagccataccccttttccacaaaagtttgtgaaatcagatttgtgcgaacaagagttaaatttcagtttcaccctccagactcctttctcttcatcattcaggttctttctctacgattttatccatcttcgtgtctctaacaaatttctagatgctgactacttcacaatttatatttccaatttacatctctctcgtactctagacacatttatcaaacggcctcatttgcatgtccatctggatgtcccagaagcacctcaaagtcagcatgtgccagaatgaagtcctcattgcccttcaagcattgcattcccacctgacttccccaccaatagacatcactcatccttgggtcagtaagcactcatcatctcatctatcactggtcttatggattctgctcccctgtcctctatccatctccagttccactgtctacaagtttgcttaacctttattctggagaacattcagaggtcccatacacttttcctccagtttctcctcatgtcaacattctatataaccatagaataattatcaaaactaagaaattaaccttggcacaatcctgttaactaatctacagaacatattagaatgttaaccattttcccataaatgccatgttcagttctgttttctgtcacaagattcaatccaggatcccacattgcatttagttgtcgtgtcttcttctgcatttagtattctccaatctgtgacaggtttttagtctttgcttgtcttttgtgaccttgacactttcagagtactggttcattgctttgtacaatattccacaattgggatttaactgatgttttctcatgatgattagtatgagattataaattattgggaaggacacgaaagagatcttgtgcccttcacagttcatgacagcagctggtatatgagattgacatgtgttcctcactggtgatgttatccctgatcccttggtgaatgcagtatctgccagaattcttcattgcacagttactttattccctttgtaaatatttgtagagagaaatgtatcttgtttctgcttaaacttctgcccatttttttgagtattcatcagtggttcttgtctgaagcaatcattactgtaaacttctaatggtgcttttctgtttctcccattctttctatgtttgttaattggaattctccttcaaggaagaatggtctactcctccatttatttaagtgttcacttattcgtttatatcaatgtgaactcatggatgttattttaatctttgctattttttcacttttcaagttgctccaattttagttattgtgaactctttgaagttggctctttggtgttttaatgttacacatctctcttttttaaagattgcttttatacttttcagcaccaaaatgtgctacagactcacatttttccattcttaatcctgaactctgccaggccttgttatctgtattgatgaatggtatttgtttttttgtactgatgaatggtatttagaaaccaagatcttggtgctgggtgtgctcattgttactgtgggttaactgcatctagtttctctgagtgaatggggctgggaaatgtacggatgtggactaactcatacagaaacacagctgtatctatctattgttctacctttccatatatctgcagtatatttttaaatcccatgagtccatattgatagctttgactctactcagctccacagggtttattctagtcacctctccttttcttatttgaatcctctttctccaagtaagaaatctggcattgattatctataatttctttctttatttaaccctaatattaagttaggttgtttcatacttgtgtaatccttaatcctataaggaaaaaaaaactaaagtacaatgttggtgtacagttctttttgttttccttcctctaagagtctatggtataaactaagacttctttatctgctggttaaaccactgaaacaggtattgctggtgatttttgttcaccttggatacatttttcacatggtagtcaggtttattcacttaaaataaagatcagattctattgctctactgcttaatattctccatatctcccttgagcccataagacaaaggctcaagtgtttggtattgcatataaagttcttcacaatctggctcttatctcgtcttttcattgttagatttctagctcttacactaaacatgattcagaactccatatatgttcattgacttaaaaaaaaaggtatacaacttttgattaataaaattactctgagagtagtaagtcagtgataacttgcttgggaggtaaaatttaaaaaaaaaaaacttggaaacaagagaaagcataaataagattggttgcttgtctaccatggatcaagcactttttgaaggtcatctttgttaaacttccactgtgaatgtggcacagttaatgttgcagatattggaatcaaaacgcacctgagttcaatcccagtttgctacttgataagaacatctaaaacctaagttgctgctgttgctcttgccccagtctccttccctgggttgggtctaatatggagggtcagaacagctgatgtttgacctgagtcaggaaggataacagtgtgttcatcatggtcatggggacagccaaaagaaaaagaaagggcaagtgcagtgcagaaaaacaaattttgtctacattagtcttttccgtgggtactcttttatatatgtattatgtacactgtaaaatgtgtataaacatattttgtaacataatacagcagaaaggacgtagaaatcaaaactagaagattcattctgcttttggccatatgcatgaccagctacataacccctatcatgccatttcatcttcttgagacatagattcttcctgtctaaaaactagggaattgaatttcatctcttatgccacttccttctctttgcttctcattttccctagctttgactaccacctatgttgctgcctctgacattcatttacttttactttcgaaatggatgtataaatgttgtgaagtgctatgcctatgaaattccatgagggaaggaggggaggaacagcggagggaggtagaggagagcagaggtgaccatgaccgtccagcctcaagtctgtatcatattaccaagttattgaatgtttcttaaagatgtcataacttatccactacattcgtggtacagggttatctactaaccacacagatactgccctgaagttgatcaggcaattttcaattgtatgatacctattacatggccagctgtatgtgtcttggttaaggataaaaccagaagaagaaacagaatcagattctggcatggaaaatttttgctaggcatgaagagtagctcttatgtcaggcaaattatgaaccacatcaatttgtagaatgtctttccctgtgctatttcaaaactgggtccacactttcaaccccttcatcatttaactgaactcttagaaggtgagatggactacattgcccccttgagagctgttttcacattttatcagattttggtacagttatataacattttcagtcttgtcattgttatcacagtacaacttttgcagaatgtggagactacatctcacacatatatactgctgcctctgctaagttgccccatatgttcaaaactcatattttatacctattccaagacaagagattttcctttgtaaattgaaaccaatgtcaattttagagtgaccgcgtcaaatcattattcaaaattaagcaccatagtattcttaaaatagtatatttggttatgacattgtcattgtttgatattttgcattgcttctgtctcatttaatccatgaagcttctgaattactttgttgtggtattttgctgcgtcattatggtatttccagagtactcagaaacacagacacctgttttgttgacttgtaatacaacctgaaaacagaaacacggagctgggctgcactcatgatttcaggaccaagggcagttcttctatgggtctttctactgatgtatgccagttagggctgtgaatggttacactactgtgctaccaattcagatgcattgcaatacttaagataatagaaaagtacttctaatggtaatataccttaaatcaccttttcagctttcaaaggctcttaaggcaaagcactgacgttctttcagttgaaataacgatgtgaaggtccttattatttaagacttctaaataagccagatttaccaatgtcaaattactggtgagtcgtttgaccccatatttatttctaatttccacaagctgttggtaagagctgctgtaaatcaggttgccattgatcttggctcccacttgtgtaattctaagatgaactgcctatgatcaacagaaaaagacttctgctctgagggaacgcctgcggaaggaggtcccaggatgctctgggaacatgcatagttattaattattcagggaagaagagagcagatgctggtctacataaatggggtggaggggaaccctaatgtaaatctatacatcaggaaatatgagagaaaagggtggcaaaatttggccttagaaaacagattagggagaatgataagcatggctgtaataggcaatcacttaaagctattgatttaattaaacgtaactacatatccatgtgcaaggcacttaaataattctcacagtcagacttcctgtattttatgatatgtttatttgagttctctgtgttcttagctgaagggaaggctctttaacctcccacagggcttggtctatttccacatgcaatgaaaatacttgtgagtcagtcatccttttccagtgttgacatcctcatgttgctgtggtcgtccttggagaggggtacaggggggaagcccatgaatctgaagaaccttataataataagtgttcattacatccctctaagacagtcactgtgcctgcttcgtgtctgctatcttatgtaatactcacaacatctctgtgagataaatattaagagaaaggttttttttctcctttgataggaataggagaaagagatagtgattgtaatgagggagaatgaagttaggaatcagactctgcttatcactctctgcatgaaaagctgcagggcaggggcgttgcttactccatctgagttgcagttttgagactgtagttcctatagttcatatcttggtgtaggtgggtctttttacacttaagatagaattcaagatatttgactatacagcaaattgttgtgaatgaattttacttttgtatcaactcaatttcataatttgaaattcattttcataaggaaaaatccctcaaaagtgtttttgaaaaggaaggggttacgtggtggttaaggtatgtgggccaagatactgggcattagttgtttactttccatggcaacatttgtgtcccttaatcaattctcctgccatattcagggatttttagggtaccttccttcatcttggcccagacgcttgggatattccatgttttcacacttttgcttcaagaaggcattgggtatgggagcaggggctcgtgtctgtaaccttagcacttgggaggccaagagttcaagaaggcatcggcatagaatggccaagcacatggtggtatccaagcacacgttgtggagctgaaattgcatcctttctctggcattgcttttgcatctgtaaaatggaaggcataacaggtcccagttcatggaatcgttgtgaagtgcttagcatagtgtctgctgtttactaagtttattctgtcctccaggcctgtcaggtcttttgtattttaagaaggaaacgggccaagaagctgagctccataaatgttatatgtgattattcagataccttgcatccctcttattgttatcctacaattaaggggctacgttatagtgaatgtaagcttcatgtcccagcagacgtttgctgcatttatgggcctacccatgctagagctgttggcagtagacgcttacctcccttgtggattcagtcatgtagagcactgtattcccttgtgcgaacatctctaaatttcaaagagccttgtaaaatagaaaggacagtacgcaaatttatcaattctatcagttaaaaatatgacacataaacttgacttaggaagagtaattttcacattaagtgttccagtagttattaaagtttaaatctacaaccaaaaacatagaatgatagcagtatagttttcaggcttccattctttgctctgacagcatggaatggataacacagagacacttgctgtgtgtgtgcatcatttgccctaggtgaccctattctgcaactttttttctattcaacagtgtcttccacctttttttttgtttctacaaactttctggagttctcatcatccccacatttcaagctgctctctcattattaatttgtgctaactagtaaatgactaacatcagtttatcaataacgtaccctcagtaataggccaaggtcaatcttagaacacatatggtagcatattttatgcaagtctcattcgacatcagaccggattcaaatatccattgtgatgcaagttattaatagaatccaggtgttctttgttttgttgctagactttctcgctctattatttagtgaaacactgatgaaccaacaggccaaccgcaatgaatagcagactcagcaattagcagtcatgaaaccttctagtttaccatttgcattctgttgtgcagtaggtagatgaaggtagaaagcaagtgataaggcacatttttgttagagtttctcttctcatgcaatgcgtatgattgcctcctggtaaggaaattggatctacatgcttaaatacttttgaagtgctgctcttcccttatgccaacctccatttctgtgtcttaattgtctttcctgtgcaccaggggggctcatattttccctcttttgctccaacttcattatctaaaaacatacgtcagtgtatttacttttgggctgcattttctttccagatatttttcacttacttcacaatgcttatttatttgcaaatatttcataaccacgatcagcctaagtcatccaatattcaggtattttgctcaataaccgatatccaaacacaattagttcgtgaagagtgttagtcaatggaaaatcttggcattttagtatgttgtcaaattaatcattcctatgttgatttaattcagtagcattagagaaaggaagaggtttgtgtgatctttcttaattaaatttatttaaatgaatttgcatcactacatcccaatatgtaacatctctttaaattgtgagaatctcttctaatcagctcaattcataagaatttagattcagaggataggttgaaattttcacgttacctcgaggaatagggaggaatgagttctaagatatatgaggtttcagaaatattataacatgtattttaaaccaaatgcagtagttaatgctgagacaaaggtgttgtgtggtgctccttgcacgtgccatgtgaaatttctgtcatatactgttacctgaagtagccttgcccaccaccccacctgccctttgaatgccagtgtgaatcctacatgtgttcacacaccaggtcatttcgcttctctgtatgaagctgaattagtccgttctcactttgctatgaagaaatacccgaggctgggtaatttataaaggaatgagatttaattgactcacagttccacatggcagggaaggcctcaggaaacttacaatcatggtggaaggcacctcttcacagggtggcaggagagagaatgagagccggcaggggaaatgacagatgcttacaaaaccaacagatctcccgagaactcactatcatgagaacagcatgggggaaccgcccctgtgattcaattacctccacctggtcctgccctggaaatgaggggattatggagattacaattcaaggtgagatctgggtggggacacagagccaagccatatcagaagcttttagcagttatcttagctcacaatggactcttccttctcctaatttttctgacacttatagtcagaatcatgtaacttagcacaataaagtcttgcattgaccttggattgattaacatcttctatgtctttccaagctttttatgtctccaacaaaattacgtatgtggactaaatattctactttttacattttccagtgcctagtatatagtaattcacattcatgggtatttgtaatttgagtccatatagtttctgactatggatccagaagatgtcattggctgaaattatgttaactttttttaatgcctcttcatactatcttgtatatgttcagtgtccaaattaagttgttgtctgattgtttccccaccctccacacataaatatgaacaaacaagcagacatttactctgaaggagtccaggtacactacctaagcgcatgtcaaagaattattttaagtgagacttccagtttccccctccgattttatcaaaaaagtttacatagatatttcttctgaaataaagccaagaaagacttaaaaccacatttacctaaacatatggaacatgtcctcatccctaacaaaagctctcaatgttatcaattaaaaaaatacaacctggaattgagacctgtattcattttggaacaaacctcaaattcgtatttttgtggtgagaccaaattgaaaacctcatctttaagcaataaatatctctgagcagattctctctacttcagccaccaaagtaattccttgtttccaaaatttgtagaaaagcttgtgagcaaattatttctaaaatgacagactttttcctctgtacttcaaaaactatatattgcatgcctactctaggcatgggattgtgttaattgtaccatggatgatgtaacaaagactaaaataccatgcatatctagggtgactatatagtttatcaccaaactagaactgttttgagagtgaaaggagagttgttagaatcctgctaggctgatgagcataaacaaaattctgcatgtgtagccaccctgtacatctgtgtcagtttcttatggctactctaacaattaccataaacctggtggtttgaaataacataaatttattctgtgacagttccagaggccagaagtccaaaattagtatcactgagccaaaatctccatgttgactggctgtactcctggagactctcaggagagtccttttctcctctcttccagcttctggcggctgcccacatgccttggcttgtgcccgcaccaatccagtctctgcctatgtggtagcattgcttcctcctcttctgtctttatgaaatcacgctctgcctccctcttaagggaacacttgtgatggtgttcagagtccaccaaaatattccagggcaatatctccatctccatgttaacttaaccatagctgcaaagaccccttctcctcatacaaaacgatgtttacaaattctagggaaaaggcctgatatctttagaagatattattccgctcaccacacgattcccatcttttaaaattagacacctcatcaggaagtattgtgatttggtgacacatgagtgatatggacaatactgtgctgtagaagaaacaaatcacttgaccttgaggcacccttaccttgaaagaataggcagaatttggaaaaatacagaggaatgcatcactgacaggtaaagcacaagcaaaggtttggaagaggggctaagcaaggatgtttgggggacaaaaaaggagaccaccttgccttgaatatagagttcacacaagagcagcaggggagaagcatgaacgtcagtttggcatcagggggctggtttttcctcattccaagctcttctcatttttctactttatttacttgaaaactctctttctccttaatctttcagtcagttaatctttacacctccatgatccttcatttcttttcccctttgatgatttctgatgctctgcttctgaactcttcctaagttctgccatagtgattcccctctgtctgtactgctgttcctactgctttgctttgcagctcttctgcatttgactgtgagctcactgaaagaaaggaccgtggcatgtgcatctttgtgtctccagaatttaattagcacagggagtaatttataaggggtgaatgaatcagtatggagatttataccaaggaccctcaacttcactgaaggtctttaatgatggtgctgatgttagtggtggtcgtggcggtatttaattattttttctaggtagggatcccttctttcctcctcttcccgttcacctgctcttcatcacagacaagtatggagctcctcaggcaccatccaaattagggtcatcctaataatttgaccccttcatctacttaggaggaaatactgaaatcctccctaataaaaagctaggtacagtatgttctgtctggagatattcagagatggtataaattattttcttctgtcaatttcaggtatgcttgtctcactttctcatacgtattaactcacttttaataatctacccattttctcttgttctgcctttaggcaattgggaaataagtgattgggcacttgttcttgataacttgtggatggttttggtttctggttgctgtaattaaaggtgacttaagtagaagaaattaggtgtctgcccactaataagcaaggtgatgttcataagctgctttgccactattggcctcagagcttcaaccccagcaacttccattaaagccagggattaactattagtgcagcacagtggaaggaaccagaagaacagttctttgggtcccagcaacaaattacttctgaatgaaacctctgattaatggctccagagttgcctctttgttttgcataattaagtttcatggagtgttacaatgaacaaccttgccatcacccaggtagaaacagccaccatttatttggccagcagtgtcagaaagtgctgggtggtgaataagaagcatttatgaggggattaggtgcatttgggtcataattgaataaggctataattacttttcattaaaaagctacaaataggatgaccctatgatactacaccaagtcccctttcatttttttttttcctgctgatctgggtctaagaacttccttctctagtcaaataatggccataatacagagaaatttgtagttatatatgaaagttgactgtttcctctttctgcacctccagcgcatatcttgttttatgacatttattatggccgcttttgttatcacacaagcagtctgatatgcaatgtagatgtcaagtaagcttgagactcttgtagctgcctgagaagaaagtcaaggttcattggggctactgggagacaacaaagtgtctagtacgttgttgctggtgagcaggccaggaatcaaccatttgtccatgtcaagagattaaaacatgatcaaaaaatgttttctttatagttttttttcccctgtggaatgacatttctctgacacagttattcctttgaccagtatcgttttgatgttaaggcagagagaccaagaggagccattgtagggatggcatcctctgttctagtcaagttttccttgggtcaatagaattttttaaaaaatgaataatagcaactacttgtatggagttttctacatgccaggtacttttctatgctctttacttgaacatatttatttaatgaagaatttgctccaaatatttgatgatttttaccattttctgtctttcttacttccttatttttaccatccctctcttcctgaatttatctatttcctctctgctcctttctcctgctctccctccctatctttcttcttggctatctttatactgtgtctgggatttgatcaagggagaaagagaaagcaatatgaaacctgaagaacacaattcaagccctggaactaccactagacatgagtgtgattttgagcaagctgatgaatcaaattgggccctatgttgcttataaagaagaaggaaaaggaggagatgaagaaggaggagtaagaagagaagcaggaaggaatgaagaagaaagaaggggagaaggaggagaagggggagaaatagaaggaagaggatgagaaattggagaaagaaggggaggagggaacagtagtaatacctattctacccatagtaaaatgttgccataaaaatcaaaggagacagtgcctatgaaaatcctctgtaaattgtaaagaactctacgaattcaactttttttgctgacctcctaatggatgttttcaggaattttactaagatttagagccaggcatatgttttttaaaagagagagagatcatgctctagacaaattgggtgcctcattatacacttaccaggaggaaaatgctgccattcctggctaaaaacccatttgtcttgcaaatatctataatgaacagattttgggataaatactatgtaatctgtgatgacagttctctcatttcttttttattagttcaatcttctcagcatctgaaccacatagctacagaacctccataatcattaaggcagctgggacgtatgcattttttctcctttccttggcacatcacagagtccccaatcagtcccttgttacaaggcctatgttctagtagtagttaaatgcacctgtataagaatgccagaacagaaaagaaaacaaacagcagggtgcatggcctttgcaacaaagttccattttcacaactgacctttccctgggtatttaaaacttgggttttacttggagcttgtggataatttgcattgcactaaacatccctttgcttaaaatagataatctcagtggaatataaggtggttgcagtaaactctaacccaccttattctctatcccttttccctttgtctttccctaggtaagtgatatttgattattgttttgagcttcttcaggagagacctcagaagcctacctacctgtcaatcccattggaaggaagtctttggccagttcctattcatccttcccaagtggtcccattccatcttttggctcctgcagcatggcggggcacatggaggtatgactgttcactgttaatgggtttgcaactgttcatggtaaaataaatgtgagttttggatcagtgtcaatgatacaattatgagcaattcctgggaactgaaggccaaaaaactattattttacctctgtacgtcaaattattgtgtgggttctcatgaattctatgttaacctatttactaaaagtgaacttcaaccaaacatctaagtgaattataataatttcatttctaccaatgacatcacaaataatgtctaccttttatgaaatagaagaaaacagtcttaaaatgtattttatttatatacccattgaatacacagttgggtctgagaaaagtcaatctgccttgttcccgaattacagagttccacacgcttctacgcaggagttggaagcatcgtataagacatcaggaaaacaaaagcacagagggacaatgggtgatgcaattctgagaaatgaaattaacattttctttgtgtctatcgcttatggtacattgaggcaccattccataaaagttactgcaaaactgttctatcacctctatgatcagagtctgtaatgtaattgttgagcgggcttccagaatcatgaacctcactccacagtacctgcggagtcttttaattcaggtgactgtgaaggcaaatcatgggctgacaatgactggaatctgcaccagaagcaaataaaccgctaactgcagacctcaatctaaataaaatacagacaggacgacagtgtattttgagtattactaccagaaatcccctccctctgccaaatcaatgaaaacgttacccaaatgtggctaaaggaaatttttcactcggattcaggcagaggacatgtccttcattcatcatcctagttctgtatcatttacggacacagttttacattccatggcggttaatgtttatgttatgttctttattagtttaaatacatggagcatctctctttacttgttaagggataattttcagtaaaactaaaatcatgattctcatatagaccaaaaatagatgatcattaaatattttatttaactcattaatgaggaaatctggcagatgttatattcgtttcaaaatgtaagtcaaaggagtgcaaatgtatatgaaatatagcactattgactgtgatttgcaaatggacaaaaaactggctttttctatgaatttgagggaagtcaactgaacctgtaccagatagaatttatttgtatgtctttagacaagaactattttgcattgctatcaattatctacaatttatagagtagtaaaatagctcagaagcaaggaacatctagaatgaaataacccaagccaaccagcagccctctggggtgctctgtctagggagcggccattcttaggccattcttacttctctaataaacttgcttttacttgaaaaaaataataacccagtaaggcatgctctaaacaatgcattgtttttccctgaagatgtttggtaatctttttgcttatttgtaatttccttacacacttaagagtacagattctgcaataggaagttgtcatccaccatactttcagatcctgcctatgctcctgtatcaaagttcagatcggtgtaaagcctggaatgccagccttccttggattttgtaagcttacctaccttagctttgtatgactcctggaatgcctagttttaccacttctatcaatgaagaaatttttagtattttcttggaaaagtgtagattcttaagaaatatttgctcaacaaatgaagaaatctttaaacctatgcattaactagacgttctttactctttggttatttactgagtgacatgatgaaaatatccccctagtgaaagaagttgggtttgaagctttctgtttgcaggctgggtgtggtggctcatgcctgtaatcccagcactttgggaggccgaggcaggtggatcgcctgaggtcaggagttcaagaccagcctggccaacatggtgaaaccctatctctactaaaaatacaataattagctgggcatggtggcaggtgcctgtaatcccagctactagagaggctgaggcaggagaattgcttcaacctgggaggcggaggttgcagtgggccgagactgcaccactgcactccagcctgggtgacaaaagcaaaactcagtctcaaaaaaaaaaaaaaaaaaaaaaaaagaaagaaagaaagaaagaaaaaaaaaaagaaagtttctgtttgcaggtttgcccttgaaacatgttttgtccatattaattcattaccctttttggtgtggcatcccgcagacctcacacctggtttgtgtcaatagaattgtgatgaagccatagcacattatattagctgtgtggtgggttgtttcaaatgggggtgtgaatcaggatgcctaaattatcagcttggtccacctcctcatgaagaagtccatcttcttcatcaatgaagaaatgtttaatattttcttggaaaagtgtagattcttaagaaatatttgttcaacaaatgaagagacctttaaccctatgcattaacttatcaacttggtccacctccacattgatgaagtaaggactggaaaggaaaagaggtggctcaagctgaagaggaggagaaggcaggtgctgcccagcagtgatagaattcttcctggtatagccttgcgacttcagcccctgatctcaagcaccaggggaggccactgctctgttctatctgtgggtgtgattgcctcccagcagatgtgtgagagtcatttctgcatgtgcccgtttgcctctgcagaacaccgcttcatgctgttgtcagtgatgaaaatccttctcggtggtctaaagctatggtaccacatggacccacagtgatgactttttcagggaggcggtgcttctttccaccacatcccagaaaatcatatcattttcactgtgagcagctctcactgagattcccttaactcttctcacacagaagatccagctgtgctactaagagaagtttgaaagtgaaagacctgctccaatatttttcttctttgtaaaccatctggatgcttttgtgtgtgtgtgtgtgtgtgtgtgtgtgtgtgtgtgtgtgtgaagtcttttttttttttctttaggatgttaagggtaatatgctcaaagagagcagactcttcaaccaagatctgtcacctgcgtcttcaagccctaatgggcacctgtgtgctagtggatttactgtgtgggtttctcttccagatcagaccttaagatcactgttgtgtgatgtatctcagccttgatcctttcttctttggggtaaattggaaccagacagtgtcactgacttgactgagatgctgaaggtgaccatgtgtgggctgagtccagaactcagatccgtttactctctgtcatgtgtttgattctccgtggcacgtgcagggctcagatgggaaggagagatgctacacatttagttatttattacttagtagccagcatttactgccaattacttgaatggcccccacacctctaagaattacctatcaggcatatactcagggtgaatactcttcagtctgaaagctattcacatttcctcagggctcatggacttcgccgtcaatgtactttcttgtgttttgtaaatacaagaaaatgtgatcacagatactattttttcctctctatgcaacctcctaggtcacagagggtgtgcatctccaggatgatggaaagaaaataaaggttgaaaatgggggatagggaaagagcgtggggtgccgtgactgtcctttgcatgtgtctgctcaggctctgcagtccatcccgtgtctcttcttcttgtccaaaaattctacccagatctaaaaacaatcaaaatgtcatagaaaacttctcccagactgaggtgctggattatctgcctagctctgagtgactcagttctgcatatctccattctcagacttctttatggagcaccttgccatgggagtgcaactctgagtggaccaaccacctctgcagcccttcttcctctcttttgccttctgccctctcaaaagcatatcacacctctcttccccagcccacggtccaaagcagagcatccccatgcatgaattttagttgcagactgatttctagaatcatgatgaggagccacaagcagtatgccaggtggtagggagtgagatttagcttccttatataactctctgcagctcattcactgaatgtcacttttccttgcgtccacatattatatctcattctagcagaatgcaataaggtggaaatataagggcttttggaatgcagtttattaagacatgttttggagccaattggaggagcactggctggaaatgttaatcacagtaaaccccagcgtacggacctgcctcccgtgttcgtttgccttggggaattggagcacagtactgggctggtaacattctacttcaggttattattatgatgatgatttcccttctggaatatgtatcaaactgtatatctttatttattgggaaaacaacaaaataatattgaagggatcgccgcatagctactgtgtacacgtggagtaaaaagaaagggattcctagagggaaacaagtggaaatgttgaacccctagaagattttctgggtattggaaagaaacggaaaagccactatgaaaaaagcaatattgcatctctatcgcaatgagcttttccaggagctggaaaaggcattattactcttggagaaaagagatctctcttttttcccctcccttttgatttagacttctgtgagccaaagtgttctggtgttttaatggtctgttttaaagatggaaagggcccttatgtgtcagaacacaagcctgtcccagccagcacggggctttgtttgattatgaagcttgtttgggatagatgatatttttatagcttctgctttgcttcaccgacggccatattgatgtagctctccaggacgggcctaataaatagtttataaaactgtaaggccattctcttgtgtaatctaccactgtgccttcacagactgcagaatcgcacatccagagcgagctggcttctcacacacaagccggccacaggccctggggtgggaggcttggtgtgtgtgcatgtgtgtgggcagcttgaaaagaaccacctgaacttttttgtgaagattttagaatagcagtggagagtaaaatgctgagattgggtgtctcattaatgttgttcaatttgtgctcagatgcccaggctgctggaagggctggggctcaaaagcagctgtggaataccttcccccagggctataagcctgtgtgatctcaccgtttgccaaaaaaataagaagcagtgggaagagtgtggggagatggaataatgggtagaagaggtgagaaaatgaacagagcatgcagtgcgcagaacctgcaaccatgtcagctgcctttctaggaggacggtagataccggctttccctggggaaggataggggctgagcccctgaggggtgcccaccagcagcaggctgaccaccaagggaagggggccagggtgtagatttccttggcagtccatggctggatgctggtgcagtggacgcagggctcatctctcgggttggggagcacctatgccaacagctcttcctgcatcctctttaaccgacagacaccccatgaagcatcgatcattatcatgattttggagatgatgaaacagcttcaaagaagtttataaaacaaacaaaagcaaaggaacatcaacaaaacaactccaaaatttgccttttggtggttgagctagtaagtggcagggccagaattagaacccaggtttttgtcttatgacacagccttgggcattgagctgtgcgtggcacgaataatgttggtgttacatgcaagcgaagcaggaaactatttatgagatgtgattttaaacacttaagaaatattctttcccagaaatccctgcggctgataatattcacctgagcatctcaggctgatgtctgaaaacacaccttgactttgaggagttgagacttagcacaattcaagtggccctgggagagtaacaatgtaagctgcggctacttcttgaaactccattgctgtggcctcacagggcttaaagtaattggaagaagattccagacaaggcattctcaagctctgccttcacccactcagtggaaatggaagctcttctgaaatcctttccaaatagttctgggaagccagggcatgctgcccatgtactccatggaatgggctcctgggcttctggggtggctgttattttttgctctcctccttctgttgtctggtgacatctcctggcacaatcccaaaccagccacaggtgccactcaggggtctctgggtctggtgcctgcagtgcctctgactatggagggtggccctatatgcacccagggacctggacttcttttctgctgccacacttactatcacatcccatcccccaacatcctagaggcattagtcttttctttctgatggtccttacgggggagagtaaattacctcttggagttttgatttgtccattgattgcactcaaagtcacctcagggctcaggtacaggccaggaggtgatctgaattacaggcaccacgctctgctgagggtcacctctctaatctagcatttgcctgctcttgttgaacgaaactatggcaactctaccatccctcattggctgccctaccctctgggtctccacgggtgcccagatacacctgaatgccagggcaaaagcagtgcagctgctgagacagaactttgtgatgctgcattcacaggttttcctgaatgttccttgcatgtagggccccattcagaagcatgcagcctttgtcactgtggaatttgaggagatttgagaagattttcttagtgggctaggaaggaaaagatctggagctttttccactgggaaaagggttctctgtgatttgcccatggtcaagttttcttccaaggttcctcagttgcctccacagtgattagatggccgggtcagaacagcccaggggggaaatggacgttaatcccccagcacctgtgcagacccagcacccttcagttatatgatgaggagagagggttatctgtgggtgtccgtgggccattagaatttttaaaacaccaaggaagaagaaacaagaatgtagctcatgtccaggcttaaacattaactgtgtaacctcagtgcgctcagttcagcaccgctgtctcaagctccttttccttaacagtgaataaagaacaacgaaactagccctagtctctaagaccgtactgatgggaatagcgtgaaactaatatgtcaattttttttttttttttttttttttgagatggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagacacggggtttcaccgttttagccgggatggtctcgatctcctgacctcgtgatccgcccgcctcggcctcccaaagtgctgggattacaggcgtgagccaccgcgcccggccactaatatgtcaattttaaaatcaaatcaaattgctatcaaaacatgaaggagaagtcaggaatcataagtatttgccttatttcttatgtgaacatttcctaaatcagggtttactatccaaaacaaattaacaaacaaatggtatcaacctaatccattatttgcaatactctcatttcaacaaaaacaagcaacacatcatctaatcctcggataattctggtctgcattattcttcatcaaaatcatggctgtgactttctcacccatgtcccagggccctcagtttctccctgcatgtctgtgactgtgttctaagagttccacatgtgcgtccctgatgggttgggcccagcactgtgctggctattcttgtcttgcttcttatcatcccctcaagatgcccacgagagttgcactaagggacgaggtcaggcaaatgcatgctcttaattaccatgagcctttggccgacaccccagtctagttggcctcctgtgaactaaccccaacatagaaagcagaggtctctcgcaattctagctattcattagaatcacctgggagatttgaaaaaacaaaaacaaacaaacaaaaccagtggtgttcaggggcttttccctcggcacccccaagggattctgatttaattgatccaaggtagaccctgggtgtccatatgtttttaaagttcccagatgattttaatacaaagcccagtttgagaaccacagatgcaaagatgtgagctcctcttatgtgagctgtggccttacaccgcaacagtccatatttcctatttccccaggttcgtggttgagcctgcctccactttttttctaaagcactctacttcagaggaaatgccactttgggagcacaagtgctgagaaacagtgggcctggtagcttaaggaatttgcccattgcttagatgctgaggtaggcaacttgaccatgggttgtctcatggtggaagagatcccagcaggaatacctccaggccagcataacctgctaagtctccaggaagcagaagtctagggagatccacagagagaacaggaggtaggcttgatgcctgaccagtgccttttaaaagcacttctctccatgccagccttagcctgtggaaggacagaggtcagagagaattcctcatggtggctcacatctttagcaccttcattcaccgcaggaagctgcagtgctatcatggacacacaataagatgcttagaatccatccaagttctcagctctcatccttcttggaagtggagtcacatcaagagctaaactggagtagagcatgtagttagcatcagccaggacagaaagatggccagctgtgagcctgtcttcaagaagactgccgtggtgcgggagccagaaaccagtccaccaggaacactccccacagcccaaagatgcaatccaaatttcaggagcctggctgcagaggctccttgggctctgacagtttcctccttctccagttttccttcatggtacctggacagctctttgaatggccagccctgcttgagtctcacactgctctctgcctcctttcctgcacgggcccctgctgacctggaaagtcctgcctgcctcaggggtctctccagaagcctcccctggttctgcctgtctgctgggagcccctgccccaggcgctgcagcccattctccatgcctcctctatacactggttcacaccaatttttgtctgcttatctgtttatttgttggtcttttttttttttttttctgaacattcccatgaaagaaatcagagtcaatatctgtagttactgtttccggtctggtgggcatgagcctcagggggctatcaaacagctaaaatctggttcctgtgcatgtcgaagcaatattttgcccacttgtttcggctcatggctataatcccagcacgtcgggaggccaaggtgagaggagcccatgaggccaggagtttgagactagcctgggcaacatagtgaaaccttatctctaaaaaaaaaaaaaaaaaaagaaagaaagaaagaaaaagaattaaaaaaaatattttgaatacatttggttaaattaaaatttcaaaataattttactttatcttttttgctttttaaaatgtgacctctagaacacttaaaattatatgtatggcaaaaaaatgagccatatggttgatattacatttctgcagaaaagctctggtctgcagtcggaaacaaagggccaggaattgctctcactagtgtttctctttgtatctcaacttctccttctgtccacagcctcacccatctcctcccaggcagtgcgcagaagataaaagatgaccaagatcttgcccttgccctttaattctctcagtgatatatttcactttttctaaatcatccaaacttcctctgcacagtgcctcagatagggtaggtgctcgacaaataatgattgaccggttcatgtatgcaattattatttatccagcatggttttctgtagcccttttaaaaccaatgttgttccttttattcatggattttagagtgcttaggttcgttttatctggaaatgcatctgtctgctccacattcttgaggttagtgcaggtagatggtcaggctccagtcttactgaccagcaagtaaatcacaccacgaataaatgagcaacaaggccgccgaggccactgcccgcaagactcggtcagttagttaacaaaatatccaatattcacaaatgaatcagtgagaaatcaaatgaacactgaggttgtcgtgaatatggcatcttcttaggtgagtccttttttttttttttttttttttttgtgagacacagtctcgctctgtcgccaggctggagtgcagtggcgcgatctcggctcactgcaagctccgcctcccgggttcacgccattctcctgcctcaacctcccgagtagctgggactataggcgcccgccaccacgcccggcttatttatttttatttatttatttattttgtatttttagtagagacgggttttcactgtgttagccaggatggttgcgatctcctgacctcgagatccgcccacctcggcctcccaaagtgctggaattgcaggcgtgagccaccgcgcccagcaaggtgaatacttttccacagtgtgtctggagacatggatttagaagccaggggctgggtggggcagaaggaggctggttctatccaagtctacctgcccttgaacaccctgacttgtctccccctttcaaggaagcctgcctctccatcatttctctttctccatatttttttgggacttgtactattgttttgagttgtcagttatcttttgaactgctccatgcacttggtgtatgtttatgtctttccaatgaatcagtcaactcctaccaggcaggaccatacgttttactgttcacatctttgtactgcagccttacagaatgtgcagggccttacagagggtgggaactcagcataccaatatgcttccattagttaggagagattctacaaaatggcaaaatctcatacaccttctttaaggagttaaatcattactcagctgaaaagaagtttcttaaagtttatgaatagttctaaaatatgtaggtaaacaaagctatgttaatgagcagcattgtcagaaatgggtcacagttaattggagacgtagcactccttccctagctggctccttttaacagctgaagtctgagcctttgttattacccttcctctctattctcactgccactgcccttcgttaggtctgacactatttcaaatgaagcattataatggatcacagcaactaaaacagaccggcacaacaaagattccccacgtacgggtctcctaagattgtcctccagtccggctcccattcaaatttatcctccaaataccagctgagttatatttctaaggtcactacagggctgaaaaagacttcagtggttggtcattacctgtggtaggggaagtcagataacttaaattgccacgtgtgacccttcgtgccttgagcttcatctagctcactgcatgtccctcctccccacataccctgtgctcagccactgacgtcttctaaatgggacaaacacaccttgcttgactcacccctctaatttcacatatactcttccgtgtcttgggttctcatctagaattctccttatttcccttcctcatgaggtctctcattactctagggagaattagttaccccacttcttgtgttctgatttgatttgtttatgtatctcgtaacatatagagttgtaagtaattgcagcatacaaataagacccctcaccccacccccactgcccccagactccaagttctcctagagcaagaaccatgtctacctttttccatttggggtattcctgctatgtggctggcattttacttataacagctcatttaaatttttaaattatttcataagacctattattatccctattttgcatatgatgaacctgaggctctgagtgttttcattacccaaaatcacaactggtgaatgctaaaaaccgagacttacatgtatgttctgttctaaggccagtggtctttactctgcagtgtgctactgttgctcattcacacttctattttctgtgcctagtaccacaagatggtaataagtaaaacgccaggtaaatgaatgaggccaaattcccagtatcccagtttctcttgagtaaaagtccgactcccttcccatttgttgccgcccttcccttcccatctctgtcttcctccttttcacctgtgctgtctcacgaagaaggcaggtcgtttttttgttgttgattgttttgtatgtgctgcaaacattgcaagtgctcctcccagctcacaatgacttctcccaaacacccgcttttgctttctgacattttcagtgtccgctgccaagacctgctgtgattctcgtgacacagagttgtgtgtaagagcttgcaacagccagaggggcctctgacgagacaggccatcctgaggctgtcaggcactgggtcgtaatgagcctgccatttgaaagagccacggtacaggttgggtttgggtttatcctccctcttacctcccctttccatttgatgtagattggcacagaccaggtttttctcaatgtaagaacataaagacatgaaatattctcagaacaggaaaaggccacacggctcaatatattgacctcttctgttaatatttccagtgattctccattttggtaaaagagcttggctgattactgctggcggaaagtgacaaagtgagaaggtgttttagggcttgacttttaggtactggggggggaagcgatccaggagagtgtcaggccagctcctcaatttagaaaggagtaaaagaaacgctggaaactggtgggtgttcttaaggctcacaggtatgtggagctgagcacagactagaaagtgggttttctaaggcatgaagcccatagaactatcccaaaacattacctccagcaaaatgaacctcatataccggggcctattcccccaacttctattttaaaatttatctggtggagttaccttgtggtttggggttggcattcctctttgatctgtgctaaagggcaaacccatctggccccaagaacagttagaatgttaactgtgaggatgaccacatgtattagtccatttttgtgtcagtgtaaacaaatacctttggctgggtaatttataaaggaaagaggtttcattggtccctagttctgcaggctttacaggaagcatggtgccaatatctgctcagcttctggtaagggcctcaggaagcttctaatcacagcagagagctaagcagtgtggggtggggtgggggcaggcgtgtcacatggcaagagtaggaacaaggggtgggggaggtgccacactcttttaaatagccaaatatcgtggttggtaatggtagacaactcattatcattcattacggtggggaagacaccaaaccattcatgcaggatctgcccccgtgactgaaatgcatcccaccaggccccatctgcaacattagaggtcacatttcaacatgagatttggaaaggataaacatctaaactgcattattctgccccttccctaccccccaaaatatcatgttcttctcacattgcaaaatacagtcacctcttcccaacagtccctcaaagccttaactcgttccaacatcaagtccaaagtcctaagtctcatctgagacttatcttcttctgcctatgagcctataaaatcaaacgaagttatttacttccaagtcacaatgatgatataggcattgggtaaatgttcctgttccaaaatggagaaattgtccaacaggaaggggcagtaggccacacacaagtctcaaactcagcagccattacaccttaaagatccaatataatctcctttgactccatgtcccatatccaagccacactggtacaatgggtgggcttcaaggcctttgggaaactctgctcctgtggctttgcagggtgtagaccctgtggctgctctcacaggttggagttgagtgcctatggcttttccagactcaagaggcaagctgctcatggctccatcattctgggggctggagggtggtggccctcttcccacaactccactaggcagttccctggtggaaactgcatgggggcttcatccccccatttcccctccctctgcactgccctagtggtggttctctgtgagtgctccacccctgtggcaagcttctgcctgggcacccaggctttcccatacatcctctgaaatcttggaggaagctgccaggcttccttcatgcttgcattctgtgagcctgctgacttagcgccatgtgcaagctgccaaggcttatggcctgcactctctggagtagtggtcagagctgtacctagggcccttagagccacagctggagctggagcagccaggatgtggggagcagtgtctggagattgctcaggacagtggggtcttggacctggctcctgaaaccattattttctcctaagcctctgggtctgtgatgggaagggccgttccaaagactttcgaaatgccttggctcccttttagtcatgttaatctctctagcaagtggttgctacacaacctgtctagattccttctctacaacagggccaggctgcaaacttacttttactctctgcttcccttttaaatataagttactagtttaagtttttttttgttgttgttgttgttcccaaacctgattctaggccattaaaagcagccacaccacttcttgaatgctttgctacttagaaatttcttctgccagatactgtgagttgtcactcttaagttcaacctttcacagatccctagggtgcggatacagtacagtcaagctctttgctaaggtgtaacaagggtgacctttacagcagtttccgataagttcattatttccacccgagaccattgacagtctggattttactgtccatatttctaccggcattttggtcacaaccattcaaccagtctctaagaagttccaaacttctcctcatcttcctgtcttcttctgagccctctacactcttccaacttctgcttgttacccagttccaaagctacattcatattttcaggcatctctatgccaacaccccactccttggtaccaatgtttttgtgttagtccatttttgcatctctgtaaaggaatacatgaggctgggtaatttataaagaaaagaagtttacttggttcatggttctgcatctgcttctggtgaaggtctcaggaatttaccagtcatggcagaaggtgacagggacccagcatgtcacatggcaagagcaggagcaacagatgtgggggaatgccacactcttttaaacaaccagatctcacatcagctcagagcaagaactccacattaccttaagaacagcaccaagccattcatgagggatctatcctcatgatcaaaacccctcccaccaggccccacctccaacattggggatcatatttcaacatgaggtttggaggcgacaaatatccaaaccatatcaccatatcagatggacccatggtttgtctctttaagcagggcttccccctttccaagcttccaaagtgtctctagagcgaggggtgatgcccagtgagggacagtctgcaggacagatcagcccacagtggcagttctcttattcagacaatttctccagtgcctctgttgaaactcttgagctaccaggttgggataatcttccctaagggacgagaacattgcccaagaacgttaggacaatgaggaaaggtaccaaggggcagtacttagccactactctctcattgctcttgataaaaactttctttctcaccatttgccattctggttaccggttgatcccaagccacaagaagtcctcactttcttgaaatgccactcttaacatcatatcccttgccgatataatggatcaagaaagatctaagaggcctcattgtttttatgcaaccagggtaccagcttctaccaacaatgtcatattccatatgcactgttactattttgtctcctccccttcctgaaatgcatatgaatatcctgctaaaagacacaggacatgcaattattcacacatagtacctcaagcaattgacagtcaacagagccaatgttaggtgttgctctggagatatgcgcaaatgttaggggatttgatcttgtcttgaaatttaaaatggggagggcagagtaggtgtccctaatgaagtgttccttgaaagcaatctggcagttgaaattttagctgaggtgacagaagatctgttagttcattcaaaccactttctcccctgccagaggtgaagaataattctgagtggttcctgctcaacattttttcctactgcaacatctaatggtgtttgtattctcacactgccacaaatacttctaagatcatgcaaaattctgaacatactctttctaaggagagaaaaggacaggctggtaaagagacagaatttatttgcaaggcttaagtaaatggaaagatacaatgaaacagagagagtggttttatatgcaaatctaggagggtacaactattttgcctgatgattataaactcattgagaacagaggccatatccatcttcactctgcactcccaatgctcatacacaatgcaactgtttaggttcaataaatacttcttccctgtccaaatctacttctcatcctgttagtcctgctcttatttttatctggattgagggctgggggagtggctgaagaagagaggcacatgtattgcctctatcattatttcctcacaaataaccaattaactcctgcaccagtatttacaccactatctactaaatcttgagagaaaaataaatttaaaaataatttggattccttttttattctttatgggtagagttttttttatttctctgcttaagaaagggaaataattgaaataagagaaattttcatttctctgcctgctgtgggaagacatatttcaataatgcattgagattctctgaagaggtggatggccaggctggtagagacaccagcagcagccgggcatggggtggaggtggtgagaggaaggggccgtgtctgaaaactgctctgagaggtgtccttagctctgggcaactgcagctgcagggaactctggcagaggggaacaaagtagtgagtttgctaagaccagagactgattctgcctacggtctttagccagacggctgcttatcaggagtgttcagactggaagacaggaaattaatgttggattgtaggtccatttgtgctaagctgcccatggttgcttgggaggctcatagcactgaaccctggccatacctctgtgctttcagagagcagcatcaggcattttgtagcatgaataaagacctgaaaaagaaatgacctattctgagaggatcagagcaccggggatcatttaaccacaacatgatgacgatttgtgagatggggagattggtgacatgtaaaattatctgtgtgaatgcattcaaggaggggagattgctgcttacttatttactgtcaaatgactgaaagcccaggtttggaaacagcgaggttctattgtcagttcttcctattagccgtggactactagtggcaaggtctggagaacaagaccctgattctgtgaaatcacccaggtttaagcgctagcatttgttaatccagcgggtgattgcacaggctttggagttgaacatgctcgggatgtaattcctcttctcctcttgattaggcgcatgaaagtggtcaagttacttaaagtctggaagtctcagttttctcatctgtaaaatggagataatatagactttatagacttcatggaatttctatgagagttgaggtaggaccattaaccataccattttattcctcaacactgaatctggaatcaattgagtaggtggctgacagattttttttttaatcaaacaaataaaaagatgaggtttgttgctacttgtattaaattagagaatatagcttgaatctttagctaaaattgggctttctactatctgcagtatgaaactcacacatctagtagtatagcctctcatctcaatctcctcctcttatatatgccctctcacttcccactcccccaaccatagacacacaaataagtaagcagagattccctcataagaacgtaatgagagaagaatgagtccaagctgacagtgagaaaggtgcatcaaatgccactggccccacgtatttatagaattatcctttcattgatattacttttcattctcatgtatctgtaaagaaagagatttataaagaaccttaagctttttgagggaaagcaaaaccaaacaataaccccccctaaaaaagaaaaagaaaaccccaaaaccctcatcattgcacattttcttcatttccagctgtctttgggctggttttcatagggagctgaagacagaaatcagtactcatggtgtcactctctgtagttgtggcatttgggtgcttcccatgccaagagatccaagcctgatattcaagcaggcttaaaagagcccgtcatggtggaggctgaacatacgctacagtgggacaacggatatccagaccaaggtgtccccggctcactttcagaattccagtgctgatagaatctcacttacagaccacagaatttaaaagggctgctgaggcattccagaaatagccattaacctggagcaaggatatatgcttcaatcctgcctctgccatgtcctagcagagtgaccttgggcaactagttactccgtgtctcctagtctcattttcctcccctacaaaacggggacaataatgcctatcttatggggtttctgacgagatgagcaaagtacttatgttacatacattatatgtatattatacatatatatatatttaagcacctgttattgtcaaggtctgtaatacacatatatatacacacacatacatatatacacacacatatatgtatatgtatatatacactggatacatgtactggatctgaaaggaatacatatgataaggaatcattcagttgtctttcctgctcacctggcctcgcgtaacttaaaggtgacttaaaggtgaatgatctggaagtggaagaggccattgtccaggctcagatggcccaacagcaacagtggtgttgcagcactttttctgcatgagattttaacttcgtctggaagaaacccaaatgcctaaactaatgtataaattaatgaatgcatagatgcctaaaatgtttgttttgtgggtgttttttttttacacctgaaggaatgagttttattttctataaaatgtttgactctcaatgactcatgttaaccaattggcacattttctttcttccccgaaaaccaaattgttaagaaaacaagaacttcagaacagggaggcaaattgactgcatctgtgctgtctgagttaggggactagtcgtgggctaaaagtagatggctggacgtgacacatatttggaagtaaggagtgactcaaggacagaaaggagtctgggatgagtaagtcttcgtctcctgagtagctgagcctggagagggaggggaggattctgagcatgttgcagtaaacaaaattaaggatgcaaggaagtagaatatgtttgtggctaacgtaaaagagtcgatacatttgaaataccgacaggacatctatatctgtatttatccatctataaactattggaactatgtctgaaatttcagaaacatttgtaagtcttctgcacagaagaaataagtgaggccattgaaatggatgaagtctttcaaagatcttaagtaagagtaaaataattggggcaaagtcgttggggaagggttggataaagaaaaagaactgtcatagaagttataaaaacaaactcgggtggtctaatagaattggcatcatgggagaagtgcatttcaagaagaagatgaccaacagtttcagatactccagagagatcgagaaaaatggaatataagaaaaggtctctagatttgatcattagatttcaaaataatttcacatttttcattttatttgtacagcatgtcagagctgccaaggtcagaatctgtttttcaatattacgcttttggatgtatatggagcaccgacattttattaacaagtatgctccaaatcatatcgccatatctgggtaggttttgctccctcctgcattgtgtgcatggctgttgcaaacctcaccctctatccttcctgctgagagttgaccccactgcctactcctgagagtgaagtctgaagaacctccccacttggcccctcttccttttctcccttgctcttggctcgtccagctctttcaggttctctgttctttcccacttgtaaatcttcaatctcttccacgattccttacttctacctgtaaatatgcttaggtctaaatttttctttataaagaagaaagaaacaaagaaacccagcgattctatctttccctcattttccctctttgccactaataaaaaatatttcctgcaaaagaaagacatattttccatggtttgtatatccccaaattgttgctgatttctgggaagtcattttttatactgaatctagggattaatttatttttgggtctctggccacgattcattttctaaccatctctctttttttgttttctttgtcattacccttagtggggatgtggacaacttcaacattgaatgaatacattcagtcattgatgaggagcaggaggagacagcataaaatatgtgaggataaaaaagataagagtttgagtggtgtaatgacacaggtttgagtcaaggaaggagatggtagcagctccaacaattactcatataatgccctctgtccactcctgaacaaatgtctattgaatatccatgtgccaggcgcctttctgggtgctagggacacagtggtgaataaatagatctgcagcttctgtgctcttagtgtccagcagagagaggttaatattttcaactgtggcatattaatctcaacttgtcattctctggtgggggctagagctcatgtctgtatttgtagaggcaaagcaagatggacagtgttaacattctctaggtcagtggtttcaaaatgctgacccatgatgatgctggcccatgatgaagtcccacgcctgtgaggaatgaaaacaattgggagaacaaagccagagggagccatcatgtcaacaactgtcctttctgaaattatatcctctctctctatggaattaaaatgcacccttagtttttaagaattaatgatgagaagaagtagacactgttacttggcaaaataaaaaaaaattggcacctaacttctgccctttcttttcttttaaattttactgatctataaaccccgaaagtctgagaatttctgttacaagatatctaggttatgcaggaaatacatatttttttgagaaaaaaaggatcttccagttggctcaacccaggtaggctgtggacaattgatccaatttacccaatatttacccagcctcccaccccctttgctgggattctgccaagcaaactcaccaggaaactgaagggtgcttgtcagtaaatcaatttaattgttaattgtggccagacccaaaaatgttcatctaaaatcatagctgtcactctaaccctaaggataagagacatccacttaaaagacaaaatctaaaagtcccaaaggcaaattaatataaacgacacccgggattcctgagaaacggcaggtctcgagctttccagctgaactgtactttgcgtttatctctctgtctctttgtcttctacagcatttgaaggagaaattccaagggagaactcagttaaacttgactaattaattctttgtaaaagctcgtgactgaagatgggatggtaacatagaggccgcctggccgtagggtcaactggaccctgtgctcctggaagttggggcagtcactttagtcacgcaccctccccaagcccagcaccgaggggctgtgccggtttcccagggctcccataacaaagtaccacaaccagggaacttcgaggtgattgtttcacagggccagaggctgtaggttcaaaaccagggcactggcagggccatgctgcctcagaaacctacaggggagaacccctctttgactcttcccatgtctggtgtttcactgaaaatcctggtgttcattggcttgtgggctcagcacttcagtccctgcctctgttgtcccaggaccttcttccctcacacgtctctgtctctgtgtcttttctccttttcttacgagccatattggattaatggcccaccctattccagtatgaccgcacaggaactaatcacatctgccaagactctatagccaaatcagttcatggtatgagggaccaggtaataggacttcaacacagcttttctgggaggatgagaggacacaattcaacccatgacaagtgctcagtaatgaacatgtgaataaatgattctgggaactagcaccagttaagactttggctgtggggatgacagcatttgaacaaacaggtgtgtactcgccttagtgctgaatacagatatagatatagatagaactagatagataaatatatgtatgtgtgcaaatatgtttatatatttgtatattacatgtataatagtaaaaattatatcatgatgttattgtgtgcttttgaaaggtctaacacacgaatttcaaagtagtaataattaaacttatgcacactgcagatgtcacccatggtcttccaattcctcacactcgtgagatttttcctgattgaaagattccattgataatgacggacattggcttgcaatgcgacaattccctcttaaagcagtcaaccattgccaagactgagggccctctggataggaagtggcccccattttaggaaagagggctccaagagggctccttcttcctgcggaaggaagaggccatctctcttcagcttctggcttagcagatcccttgagggactactgaaaatccaggaagaatttttactgattaattttaaaacatagtttttgccaaaagaaaaaaaaagcttctgtctcctgaactttggttctgcgagagaaagaacataatgggcccagactattacaatcttgacctttcatggagaggcttaatgagatggtgggaacttgttgagggctgtggggtcagttcctcagctcctcaggatgccgcaggacttggaagtgtggtttggtgggtgccatgggagctgattcccggcccccagcacctcactggctcttgggtgtgcaccctgctggctcacaggggtcgcttttgcagtccagaggcctggtacacttcccaccttgctcctaggacattttcttccctcataacccctccccatccctctggttcactcaggtgcctaagagaaggtgctggtttgaatgtgtcctttgaccccagctagaataaatgaaataggatagtcgtgcgtcctagggagggacatccactttcagtgggtggctgctatctggtgctctgccagctctccttgaaacccctggcagccttccgagattaaatgcagagctcttgagtaatctaaacccagcaagaagtcactctctcagcagcaggtcaagtgttctagactgtcatcttattgagagcaaagagaaattttgatttaaaagaaggcccgtaattttccaacaaggagtgaaagcaataacatttcttctgccccctgctgactcctcacttcgtagaaacttggcttctccgggtctggatcattcctttgtgcttggatattctgtcagaggctttcttctcaaagagatgttccttaacaagaaatgcattgaagctgaggaagggaacaaattgatatgtatttgtgagtttggtaaaataagaaagatgtattctcagcacacaatggtgcatgtgcaggcctgccttgtccaccaccctcaatccacctcctcctgcccctttcttgggtccctttctcttgcctcataccctgccccgagcgtccccgggccggcccagaggggaaggagcatggctttcacgtggccagaagggacacagggttcaggcctgctcagagatagaaatataactccctgacagggaatactgtttcgaggtggtgttctgtatatgaaaaaatctgcatcctgatatatgcctcataatatagtgctttgtgggtcttattgcagtgcattttatttagtcaataatgctgtacagcactgtctgataataaataactgcaatttgcatgatattctgggctgttagatttttttcttgttctacaagaaaattgcatttatctttcagttttctttttttttttttttttagtccaaatatcctacaactgcttaaataaagaccacttcaactttcaatttattactaaccctaactatcacagcaagcagtataagggctaagaaacatgagcctcttgtaaggggctaatctctgcattggatactgttgtgtgcaggtggttactgcatctgaagcactcctttccttcaggaattgtccctgtgctcagagagcttgcaccaagaggcatacctgcagtggtgtggacagaaagggcagtgagtgggtgtccaccccaactatgttgcatcattttaattagtttgcatctgtgtgttagactctgagcatcacagatgcagggactatatgtgattatctttataacccttggattgagcatcctgccgagtgcatactaagtgctcatcgaattttgtacaataaatcagtgcacaaacaaatgaatgagaaagtcattttggattcaatgctgcctatctgtgcaattttatgctggcatacttctggtggcaattttatatttgtagtagtttttgaagcactgtcatagactggtgatattgcataggggtgagaatattggttctaccaatcagtttctaagctttagctccttcctcagtaaaatgggaggaacaactctagctatttcttagtgttgtatgtgttcagtgaaacaatgcatgtgtttatcatagtgccacacacacagtaagtgcttgttaaatggaagctaattagtatcattattattgatggctatgatgatatcctctcttcctaccatttaattctactgaaattgttgatccttaatgtgtttaaggcccatctaccttcatgttttcagtttagattcagacaacatctatcaatgtcaggcaaagatccagctggtgagaactgaagaagagtgctttgtgtgtgtgctttatcccttaacactttgaaaatggcaagagaggatgattattttgtggatgtttactctgggccaggttctgggatattgagatactttatgtatgttaccctttttaatctctataaaaatgttttgaggtaggcattatcaccctcttattttatagagtagggaatttagacgcacaaagggtatacaactcattagaagtcacacatcaagtaaatgatgaatccaggcattcctggccacaaagtctgatgtcttactgtgttagatcagcgtaaccttcctcatcagcctcagcataaatgtcgaattggtgcatttacttcaaggagcaattcagaatcctatacacagaccttaacgaggacacagtagccttgattttaatcaacagcttcctcaggctaacgtccctgtgaatctctctgggccttgtatacttcttctgtaaacttggtagcacagcagagactatatcaggtggaagcagagtgtccttttcactgtctcatacctacgattctggacttggaatgagtcacacgtgtcgcaagcatgttaggatatataggaacaatttaattggagggaaatattttctcctattcctggctgtctgaggttctttgagtcctttcagtgttaaaatataaaccacgaaaaccacctgtttacagtgtttccactctgtcagccagtgtacctccatgttgaattgaacaagaaattgctatgggaatgcacacatctgaaagcataaacaggtatttgatatctattttaaatggaagccaaaaaatgtcattggtacttagtatttctttcctaaaacaatcccttatatgtctccaagcatcagagaaatagagaatttaagacttggaggagaccagagggatcatttgtctagccttctcattttccagatgaacaaagagatggttttttttttctttgtcccaactgtgtgatattttaaagctccctagcagaataatttcccatctagctaaagcttatagagtgaggacacatgaagaaaacactgggaattttgcagtgtatcaagaactccacagtgtgctgaatggggcccagagaataggtttgctctctgttttctattaatcaatcaatcaatccaacacaaacacaacacaaaacttgaaattaaacataaaaattaacagagtagcaagtaatcagttcttggtgtctttgctgtcattcttagcacctccacatgaataggacaggagactaaaatgtgagaattagattccaatgtcggcatgcaggagctcccaagtatcatcttttatttaagccttcttgtattttgaagttatatctcatagttatctagctacgagaataaaatgtataaaatcacacctcttggaagcattttctttttattcatttctttcattatcatgaagatctttaactacaggggtgctgaggttagcccaaacctttgcacaatactctcttctgcagtaaatgatgggatattcttcttgctcttacagaaaggtaatcttatcgataatgcttccctagttagagagatggtttgctgctcttagtgcatgttaacgatattgtccatttctggaatgaaattcagctcccatggctactttgtctagcctgttgatgttagtttttaccattgcctgaaatgggtagcaggtggctttaagtgaaattcacagtgttcatcattttttcaaccagaaaaagaaaaaacatgagtaataaagttcagtctgtgtcaataaatgagtaataaagttcagtctatgtcaatgtgaaaatctgggctgcctactagggtacagaatgtgaccagatcagtgagtgagaaggtgtccgtgaaatccccagagtaactgttctatgttcctctgaaaagaagcaccttgtggctctgaggttctttgaggaaagtcccttctccctgttcagtcatatacacctgctttctgcagaatgtcagaacccaagtttgtttgtttgtttgtttcactctcggggaatttccagtttgtgatttcatcaattcagtggctcccatatttggtggtattatttaaaatgccagatacataaagcatttagagctcagagatgcccttcttcccagagaagtgtagcatcactcttagacataaagaggctttcctaattgaagaacttgaagagtctttgttgcatctcagactccccatctgaacctgtagatcttattgtctctatgaacaggtggaatattgttagatccagggccaccagctgtcctggagcacacatcaaagaggtacccctagaattgtgcaaaaacatgatatagttgggtctgcattttacaatggatgtaagtcctcgggaccagtgttttctactataagcctaaacagtatgatgggcaaaacctgccttcagagaaatgtgtgcattacttagcagtttcacttcattctatgttataggaaaaattatctactcatatcgtactcaaaggtcttctatctctattcatgctaagctattatatttgaaatctataaattctcttttataagatgatgaatttaacttgctcagtactaatcacagttttggaaacagtttctagtgtatgcattaccttaaattgttaatctatggttttgcactttttcctgtcaatctataattaaatcatatgaaaacacactgattttacatcattaaaataaaggtgtattctgattatctctgatgactatggcttcctagcattcattatttaattgctagacattttattatcagctcacatggtgttatctaaattaattgtgaactttaatatatttgtatctaaaaagaaaatcagttttctcctcataaagtagactcagaaagctgaataggcaaattttatgctaacaacctaatatcctcttgcagttaggaacagaataagaatgtttatggaaatgtccctttcagttatttatcagagctcttgaatggtgatactgttctatcagttgcatgagatgacacatgttttatccaactgtttggtgactggatttctaaattaatgtcaagacagaaaagtcagtgggatgtaagaagttccctgaaatgtggtctgaatatccagggctgtccactctggccttgaggggttgccagaaattcttgactggggctaggaaagagagaaagggaaaaacatagtcagggccattgttacatcagtggatggggaggctgagatcacacagaaggaactgcacctactggatgaactagagaaggagtatattagtctgttctcatgctgctgataaagacatacccgagactggataatttataaagaaaagaagtttaattgactcacagttccacatggctggggaggcctcccaaccatgcagaaggtaaggaggagcaaagtcacatcttacatggtggcaggcaagagagcgtgtgcaggagaactgccctttataaaatcatcagatctcatgagacttattcactatctcgagaacagcacgggaaagacccatccacatgattcaattacctcccactgggtccctcccacgacacatgggaattgtgagagctacaattccagatgagatttgggtagggacacagaaaaaccatgtcagggagttaaaatttaaaaggcagaaggcagtcatattctaccatggctcacagcaaaacaattatttgataaaattccattatatttaataccaaaaagacaagaaaatatattcagtgagtgcctgttatgatgcaggtaccaaattaagaactttatatacatacctcacttaatcttcacagtagatatgcaaggaggatttgattgtctacatcttacaagtgagaaaactgaggctcggagtgatcagaaaacttgctcaggagcacatggctagaatgtggcagaggtgggaaattgaatcatttccattttacaccatcgataaaaattaccgaggctcaagtctgtaatataatgttaatctgtacaactctgtagcaatactaagtgtgacgctcagagacactgtaacttggtccaaatcaaactgcgagtaaattgcagagctgggattggagccaaggtcattttaattccaaaatgtacactctttccaacacattgcattccaccgcctacaaagtccttcctgttatactaaacagcctctctagggaaacaaacaactatttatctgcccaaggtgccgaatcatacttctgctttaagatagacaacataggagatgtatcttgaagatctttatctgtccaaagattgacaggcaagtctctgagattaaatttaaaaggtagcttccatgtagacatctcacctgccctgaggacatctcatcacatccattattctgtgctggggaagctctccagcacagaaaaatctatcaggatgggattctaatcgaaagcaatagcatatgccatggtattaaccacattgttctggcttggaatgttaaagcttgctactttaactcatactttatactcaacccatcctcattcccttggactgtgtgttcatgtatttatcttacccactagattgaaagcttccttaagacaagaattgtctccaactagtcattcaatacatatttattgagatcctaatacatgccagatagtgttctaagtcccgatgagtaactactgagcaagatagacatgagttcctgaccacacactttagtgggaaataccaaatggcagtgacaacaacatggtatgatgaagattgtgatgggcaagaacagtgtgtattctggaagcaaatgtaatctagacttagagaccagggggagatccttgagggaatgtctaaggggagctcaaaaggatacgtgggagtcatgaaagattgggggtcttggaggttggtgagggctcccagctacagggacagcaagtttgaaggagtgaaaatgagcaggagaatggggtaatcaaataattgaaagttccttctggatggagccaaagtgtgctagggtggggttgaaggagggaagcattggaagccacctcagttcgttccctaagtcctggttcttgcataaagacttatattgccttgtgtatttctttaacaaaacaggtttgtttgtttttaaagacttgggattggttaccctgacttgagatttaatgtctattttcttgactttttttttcctagtgttgctatcaaattgctattttgattcttggcctgtgtgcctcatttctccatccccttctccttttgtaaacggaggtctattaatactttattcacagtgaagttgttgggactaattacccgatgcctgcaaagccatctgagacgattggctgagagatgtgccatgaagtctcactgtttctcaaaagccctgattgcttccggcacatttccccttctgtttttgtgggactgcagcagcaatttatcccagtgcctgtttcctcagagtctgttactcagtcatcatctgacacctgggaggagcgccggcagcgtctgtggtactcagcctgactccttcagacacatcttcactcccagacgggaggagggatgctgagccaaccccactgtgatggggacacagccccaacactggcttccgtcttgtttcaaaaataatcaaatcccactttgtcttgctttcagggacgttgtgttcttaagcgcttgtcagaaacaattaatggtaagtttctttccctagaaattgatagcaaatatccattcctctctcctgatgttgcattctctagaaggacagaaaacaggaagttgcagtagcagagatagaaatgcccatcagactttcaagacacatttcacccagagctgatcaatggatagccaacgccaatatatcagaccctgcagagcagaacctggtatgatggcagactctttgctatgtggctgtgtccccacacccgttaccctgagtcagacattgctagttgattcaccatcccaccccacttcttcctcactatgaacctccaagttagtccaagtatgagtggtttcaggaggatgaagcggcagggagatgtgacgcttgggaactgtccctctctctcctctccactcctctctggcagctggtcacagaactggactatgtccctctcctccagaaagttaccctgtgtcacaccatttcactgtcccactccattcccacggcgcagcgagtcatcaaggacccgaggcctctcggtaggaccctggcagtttaaaatctccaagctttacctcactcctatgtctagtgcagacaaaaccactaaacctgtaaaggtggtagaagaactctaacacataattaactattccgtgcagcaaatattagaaccctccctccgaaagtacttagtttatttaatgatctatgccctatttatgattaattatgacatattgatgacagatgtataaccacgtactttttttttttattaaaaaccgctgtgtgtatttttctctgttgaaagccctgtgaattaggtaaaggaggtattattatagagttgattgaaagttgaggaatctgaggtttgcacttgcttctaagtgctcttataaaattgccatatgtgctctgatttctcgttgacaccagcatgttagttcactcctggttccctcgagggtaagtgtgcattcaccgcataggactgttgggcagaacagacaaggacctagagaagggccctccataccaggagttcacatgtctgtgctgggtgcaaggaaatggttgggggttctcaagttagcctcacttgtaagacagcaacaccttctgaacacttccctcttgagaattcactgagaaaggctttgattgtatttgtcagcttcatcaggcccaggagatgagaacatgctcttgttcctgaaaccacagcgtcctgtcctgcatgtaataatttgcaatatgttgtctccgtcacttggaaggagtcatttttccgcagcatcagtgcttcccctgggaattcctttccttcaggtattaacttgccttggtccttgcctttattcttattcttcttgtttctctgactttacatttcacgcacctgccactctcagcaactcaaatggttgacttttctttctgtttttcaatatcaatatatttattttctgtgggattttttaatcgtttttcagagtccaggaagggagaataaaatagaaagataagaacaaaagataaaataatattccttcactgttccattttaaacgtgacatcaggagcttagacagcagcctgtgtaatgggaattgtccctgggtcccaaactgagcctggagaacttttacaaaataactccacgtttagcttggaaagtagcaaggctgaaaaatacatggcagatttttggagtggggaatgaaaagaagtatgccgttatttttttctagctcctgttttctctttttgagcggctctgtctgtcgcagttcagcagaatctaaacacccacattctgtccttgtgtcacacccctggccagttgtccattagtggcgggtgtttcattcaaaacacacgcctctcatgagaaacaagtgaggacccagtgcatagtaactacagttacacactgcttaacaatggggatacattccaagaaatgcactgttggacaatttcatcactgtgcaaacaccatagagtacacttaaacacacctagaaggtacagcctactacacacctaggctgtagggcagagcctactgctgctaggttacacactgtacagtgctcctaggttatacccctgtacagcagtgactgtattgaacactgtaggcaactgtaacacaatggtaagcatttgtgtatctaaacataggaaaggtaaaaatacagtatataatcttatgggaccactgttgatattcagtctgtcgttcactgagccatcattatatgatgtatgactgtatttgagtgtctgtttctttacataaattgtttaatttagtccccgcaaacagttcgtccaatagatgatattgtctttgatcatctacattttaaagagaaaaaaatgagggttcaaagaaattaggttatttgtgcggggtcacataagtggtaaatgtccgagccacagtccaaccatacccacttgttttcagattctgtgcattttcttttgcatgaccactcttctgcttgcattattggtttgggataaggttaagtggggcatctcatcttttattcccagaagtctagggtgtcttccccagctctctttaggtatttctcctgaacatcgctgatctcgggatgccccactggcaccccactggtagtagagtgagtgtcctcacgccactttctgctgctggaatctcctaggggccaatccacctgcaagcctgcacgctcttcctggggactccaccgtcagctgcccttggccaaaatgaccctctaatactctgcatatgtcattcccactccacagtcagggtatcctggaagtacatcaaagagcttgccagaaagacctggataggaagccacacgagagggctcaagatattcatagcgttggcaaagaaggcagtaggtacagtggaagggtgtctggccattgatgcaggtgtgaatccatctgccggctcactgctgtgtgattttaggtgtaatgacaactcacccagtctcagtactttcctctgcagaatggatctaacatctgatttcccatcccatggcgagagttaaaggaatgcctgttagatggtgttaggccccagtctctccattttcctcattcctctttttctctgtactacaaacacctcatgctccgcacattacatgataatgacagctaatatttactgggtgcatcctacacccaggaatgtttctaagcattctgaatgcattcgcccatttatcctggagaacagatttttaaagggagaatcctattactaactagattttatggaaaatggaggcattgttttcaccacacacaaaaacgtcaaatatgtgagataatgcatataggttcatgagcctgatttagctgtgccacaatgtatactatatcaaaacatcatgccgtacatcaaaagcgtatataatttttatttgtcaactaaaagtaattattttttcaaaaaaagaaagaaaattcaggccaagagtagtaaagtccctttgcttaatgtcaggtagctggagccacccacggcagggcaggacaggaacaatggtgcccggatgagatcaagaacatccgaaccctcaaaggcaggcagaggctgagagcagtgagttaacctaatgactgggttagcctgcacagccattgctcctgcccgctgcattccactagagccaccgctcagccagaagcacactctgagggtgccgctcacagaagaaggcaattgaagtagaggagagcagaataatgtatttcttctctctccccctctcctccccgtctctctttctccaccctctcttccttcaaccaagtgttactgtgcatgtactatgcgctgttcctttatacaccgaggatatgacagcgaacaaaaatggtgagagcccacccatcccagagtcatctgagagacaggactagggtgaaagcgcttccaaaggtagagacggatgcagaccatgtgccagcctcaccactctttcgtctgatgccagctgagcagcagtgaagagagccggacgcagaccatgtgccagcctcaccactctttcgtctgatgccagctgagcagaggtgaagagatcatgattgtgtttaacatggagccactgaaagtgtttcgaattagaacccaagactggaaagatgggggggacagacattccagtctctaaaggaagagagagctacaagacccgtcaatcagatcatagctcagaaagtggacacttaaggaatgaagaggaagtttccttattcgaagatccaagaggtggccatatttggatgtgacgtagtctcaggcctgggtcccacacccaaaagctttctgtgcagttagcaatggttctaatctgaaactatatcaagtgatatagcttgagcacttgatgtgatatccaaaaacaagtaagaagatagtttctgagcacttgttttgttaagccaaggaagtcagatggacaaaagaactgaccttataaaccaaatggagctggtagccaggtcacctggagctgcacttcggagatgccagaacaaaaaattagtgttccaggaagtcttctgcctctgtcctccaccttttttgtttctcttcttttcttcttagtctatttcagaaaaaaaaaaatctatgtactaaggcatcaaggaagaaagtaagtctttttactcttaaagcaagtgagctgggggaagcagagtacgtggattccagatgtggtcatggcaactgaaatctggctctagccatcagctcaggctgaaatttctgtcattctcgactcctgatgtgcttctgatttaatttaatttttagtttaatttaatttttagtttccttctgcctgggccttgaggtttcaaatggattatccagatttcaaatccaaagcctgccaggtcctgctgttccactgcagattttttcttgaaaaaaagttagatcttagatctccactcccactcccataccccacattcagtccagatgcaaatcccagagctccaccttcaacacctttgaggactgtacgtccttatcagtacctatactgttggcactctaatccaagccaccctgcctggatttctgcaatagccccctggtcccagcctcagaccctctttagtcaggtctcaacacagtggccagtttccaaatgtacaccatgtcatctcttacatttctgcctcattttgagtaatagccagaaccttgagcatggcctccagagccctactggatcccctcccccggcttctcacctccttccctccactcactggccccaatgcacggctcccaccttcttcaaatttgcccagcatgtctggggacctttgcaattgctctgtcctcttcctgaaactctgtcccccgagagccacaggactcactactatattttgggggtcattgctgatccacctattacataaaatcgtatccctaatcccagaactccccatctccctttcttggtttgttaccgatgcccatatattgtttattcagattgatttctctatttgcctattgtctgtctttcttttcatttaaatggaaactctatgaagacagggacgttgtctgttatgttcactaccgtattcccaaatctgagagtagtgcctagacatagaaggtgcttagtaaatatctattgaatgagtaaatacaaaaaatgttcccagggcatagagcattgattgatgtcctctttatctcattgtatccctcatttgcccttggttttctctcagcaagataagatttgtttcataattaacattctattttttactgtaattctaattttttaaaaagtataatttcgtttttactattcttctctcacttttgcatcaaagattcagggaattaatttgttcttaccaaatagatagaggcttttgtgcttagatggaaatacttgggattttcatcacattgtgtttctacatctcagatttcaaggacaggactgactttgaatgtcagagttttacaagaagaaatatactgttctgggtggcctagtaggggtgaaaagcattcactttgtaacctcactgctggggtacaaatcttaactcagccagttacaaactgtggccttcagcaaatactaaacctttctttgctttagtctttacttctagaaactagagaaggtgaatgatgaggttaataatataagcccataaatttgaattgagaattaaatgtattaacacttgaagagtagttagaactcatcctaacttatgaaaatgtttatttataaaaacaaaacaacactcttccttttcctgtctctggaaccgtgaacaagtcatttcctgtcactgcacctcaattctcctaccaataaaatgaagggggaggtaggaaaggttgaacaatttctgactatgattttatccactctaactttcaaagtctgaggtgaggctgtctcagagccaggaagacagattttgtgcttctgatttaatttaatttttagtttccttctgcccgggccttgaggtttcaaatggattatccatatttcaaatccaaagcctgccaggccctgctgttccactgcagtttttttcttgaaaagcagagcggatgcccaggaaacattctaagaagcctctggggagatctctgggcaggcaggggcaggctgggtggagtggggccccctgggctgtgagggctcctggcagtgctgggggtagctgggggtacttagatctccagaaccatgggtgtgagtgggagggggccacggtgacagagtgacctgtgccccaggaggcctttgcagaagtctttgtcagcagtccccagtgacccagctcggcaaacgctcaggaaggcaactggcaactgtgacctctaagtggggcaatgaaagaaaggaacccacatttccatgctcaggaaaacctcctgtagaagctcaatcatcataacctctggtggaccttcttgttcaaagtcacaatggattccttgccacgccctaaggtgatgaagagagactgtgcctgtaggtcacgtgctcatcggcaagccttcccttcttccttcacctatgccctgccacccattctcaaagagttgaagattatgcttgtccataaaactcagcttgtagagccagtctttcctaccaagataatatgttcattagctcctgacatcccctattcacagaaataaaaagatctttgccactctatactgactgctttgtgtgtggccttccaaaactggatgtcgttcatgggctagggcatgcaggcaatgtcaagctatcctcatctttgcccttggtgccagtgacttgcctgcataagctaaggcaaggggaccccagggagaaggtccaggacatgtcactatttgtggtttgtcatgccagcaagagaagagaagggctatgggcccatgctgagccacctgaaattctcagcagctgactaccaccgcttcttaactcacccccagatacaatcttagaataaatctgaagtccaataaggttttccagtcatcgatagatttaatggtcttgactttgtattttctggaagttggctccaaggtgttcagctacgttgatctcctggaggaaagttaaaaaaaaaaaaaagatagaaagacaaggaaggcgagaaaaaggaaggaatagggcatctggcatagactagatgctcaataaatgtttattggatgatgaatgaatggttggcataagtcataacaagattgttatcaatgccagaatgggacctatacagccttctttgggcactgaggagacaagatacgttgcaacaaaaggaagagagggcactgagaattagacacctgagttctaatctcagttgagaggtgctctcagccatgtggacacagtattgtagctcagtgtgtaagaactttaatagcataagctccaggggccacaggagcagagagaggcctaggcatctatggatgaagcagccacacaacccaacttgtgatacaggtacagaaacaaccgatcgtaatgcagcgtgattcctattattagggaggcatgttctatgaaactatgactttgtttcaaatcacagtaaaatgagaatcatcccacagggctgcctttctcagagtattgccctttaatttaagaactctcactcatttctcaacacttggactcctattcaggaataaccttttcttgcacagttttgaaattataggtcattgagatagaaatacaacttactgagacgaattctaaatgcttctttcatacctggttttgtccacttcagttatcaaaactctttactttaacagttaagtaggacagtggtgttctggagtggaccgaggtagggtgcaaagagctgattgctaaatatttaggaattttgcaagacaattaaattgttggtaacctaagattggtcctggcagtagtgtttaccccatagaaatcagcaaacactgtaaatcggagcattcttcttgttttttgttttgttttgttttaactgtagagctggtctaccagcccaccactggatagaactcacatggttcagttaccagttaagagaatttacctggaggaatttttcacaataaatgtttggagaattaaagcaatgcatgataataatacagaataccagtcactcccaaactgcacacttttaactgtatttttatgtaatctatatcattatgttttattactttctaatttaaagctatttatgtgtttacttaaatacattgatttttaaaggaacttttttgacagctgtaaatgggaaaaagaacacagaacctcttagtctacactaaattgtaataaatgaataactttaaaataatcccaccacatatcacgtaaaatcatcccacatacttctagaagtgtgtatagtacacaataaaggttataaaataaattattgtcatagtctacagtgttttttctctaaggaataatcatagcaaaggttatggtacatttactatgaatgaggcattactatattacatacacattatgaacatataattacaaacacattaatataagtgcattagttacatagattaactcatttaatcagtgtaaaatatcctacaaggaaggtattattatatcccaatgttacacataagaaaactgaagcacagagagtttatatagcctgcccaaggtgagtggcaaagcccagatgaactccaaacagttgggttcatcaatccttgcccttcttcactatacttcatcactgcaatggcaactcctgctaaaactaaaaatacttacaatgctcgagttccttcaggactcctaaactttggaaaactttagaagccatcccatagaaacaaaatccatataaataagagtacaaatttgtgataaagttattatagccttagccgcctttgtagcaaaaatagtgaacgaaatagtaggtgaatgacagaataaattaggttatacatacaacatggaatattaaatagtctttaaaaagaatgaatgcaaattataccagaaacttggagacatttccattggtatcattgtagaagaaaagaaaaatgcagacaaaacatgtataataatctcattttttataaagtatacattgaaagtatcctttctactgccagccataggggttttaagccttaaaagtgcctgcttatctagtaaagtgtgaagggagagctgtttagtttgtatttcccactgctggtgaataggaacaagattccatataccagcttgccatttgtatttgttctgagaataggcctttgcaaatttttatttgcttattaatcccctctttttaatttgcaagagttttgtttttcttcttcatttttgtgtgtggcctcttctttgcaatcccccaatccaaaaatgttttatttgtcttttggctttgttataaattgtttatatacaaaatgttttgtttttgatggtatagtcagacatgcttatcttcttttttaaagctgctggatttttttttccaatctcaggtcaaaagtggggaaagaaggaaaaccaaataaacccaaataacacctcgactggaagtgtcttcctagcaagactcagaacctaaaatattccctatgtgtgccatgccctgaccttccctgtaaaatatcattaaatctctccagacagcaggactggagacattcgtatttaagtgttttataccccagtttcgtgcttcacactttaattcctgtctattaaccagcacatgcaggcactgggagggcttcagggccggagagtgaggagaaaaaaaggtgcagagggagttgagttatgttagtgtacggatggcacagcaactccttgtattttattatcctaattagtgggtattaggttatatttaaagcttaaatcttcattacatcctattacaatggtggatttaaaaaacctagcatgtctttgaatcaaggtagagcgttaatttggctttcctgcctcttatttggtctgtttgcccgattcttccctttttttgaactcagtgttgtatttaatgggcttgtcaaacctacatttaatttaacgtttctcatgaagatcccctgctacctgacaaagtagtgaaaggatgactgtttctcaggttcccctctgggtaccacatctccagtgcactcccctgcaaacttgactctctccagctgttcccagacacacaattgcccaagtttaaagctgtccatttatctttgactcctctcacctttgccccaacacaatttaggcataaattcaaatgcagtctacaaagacatctgctatagccatctcctcctcccagtcttgtctgctcagggtctcttgacttcatcttcatcttctttggcctgagtcatcataatggaatcagtatcaagtccatcctgccaaagctgtctttccagagcatatcttttgccttcccgggttgaagaagcactagtgcttaaaggataaaatccttggtgtggtacccaaatgcctttgttttctgatccaaaactacttttgtcaccttatcctgactattcacataaatgattggcagtactcttgtgggatgcatgttctgtagctgtgtgaacagggaagaaactcatgccctgctctctctcatcacatagttctttctggggctgcatcgcctttcctgctgcccaaaatgtgcttccccctttccccgggagcctaagtccttgtcatcattcaaagcccaattcaagtgtcatctgctctctgaatattccctgaggatcatagtaaaaatgaatacccccttttttgatgcccctttgaattttttaataccctgattctaacatttgcatttatcttagtgaattgaggttctgctgtctcttgactaattgcatgtctttgaagataggaccagcatcacactcatctttgtgacttttgtccataggagattgagagtaatgttccctaatatatgtttgcagaaacaagaaggaaggaagaaaggaaggaaagaaggaagggagggagtgagggagggagcaggagaagggaagggaagggaagggaagggaagggaagggaagggaagggaagggaatggaagggaagggaaggagggaaaaaggaaaaaagaaactttatgctaacctttaacaatgcttccctgcacttaacttgcttgtgtcttgttttcttgctttgttttactagtttgtttatttgcttattcattttaagtgatataatagcacttttaaactggctgtggaaggctgcttataaggtttatttgttatgaagatttaaaatgtgactcgcaagccaggcgtgttggctcacgctataatcccagcactttacgaggccgaggtgggtggatcacttgagatcaagagtttgagaccagcctggccaacatggtgaaaccctgtctctactaaaaatacaaaaattagccaagcatggtggtgcgtgtctgtaatcctggttacttgggagactaaggcaagagaatcacttgaacctgggaggcagagtctgcagtgagccaaggttgcaccactgcactccagcctgggtgacagagcaagattctgtcttaaaataaaataaaataaaatgtgacttgcactgactatgtgaaactcacaggaagaccccaaaagagtactcatcattagcatcattaatcacgtggtcatttctacacagctctgattccaaggcctgctaattcctttataaaagagaaagattatttctttccttttttttttttttttgagacagagtctcactctgtcacccaggctggagtgcaatggcatgctctcagctcactgaaagctcttcctcccggtttcaagtggttctcctgcctcagcctcccgagtagctgggattaccggtgcccaccaccacgcccagctaatttttgtatttttagtagagacggggtttcaccatgttggtcaggctggtctcgaactctcgaccttgtgatccacccgccttggcctcccaaagtgctgggattacaggcatgagccaccgtacctggccgaagaagactatttctatagtagaacctgggattcacataatctgggtttctttagttgtgcttcatggggaaattgaccataaccctcctaccttttcccctacttgggaagcagaatgagggtcaagggaaaaaaagaaaaaaaagcccgagtggctgtcatgctctaactgggagcacagagaaataggcagaaactagactggaggttttatggagcaaagcccaatagctaatattaatgaaattcctagaagaaaatagccagaattgaaaacccttcgggagactctgggaaccatctgaactaagagagttaatcagaaatgggacctccagaggcttcccatctccagctaagcactgcagcacctgatcaggtgactttggttgctgatgggtgacagattaatttacaagaacgccaagcaacagaaatttgaaaataaaacaaatatacactttataaggggaggaaaatgtgattttgcactccctagaatactttacccgaagcttcatcaaccctataataagatgataccttacctggatgaaacgttaatgttaaatattatgagaaatttgctggagattgtgctgtacgtatttctggtctaacttgtctctcctgttttaataaagaatatgtatgtatgtgtgtatgtattttagaaatttccattaggaattaatcctgatgtcttaatagattaaccttgctggtgcctaatataatttattttaaaaatgaaattcctactacagcaaagattttaatgggtagcctttttttggtatccctctggaaatatccgtgcctgaggctgcacttttcctaaaggcccactcccctgtcgactctggggggaggccctcctgcacaacagctgtgaaatcagaccagcgtttctaggtagaatctctcagacaaaggatgggactcacctaccccagcattttgcactgcctgaaatatcttagccttttaatagcattagcctttgctctcttttcctacccttcctctctgggcaaccaagaggcatttcactactctaggatgacagggaaatgtctgccttcatgttgaggaggctcaaaggaccaagaacttagcactttcgaatgcctggtgcatttaggttctcagatacaggattttgacagactctttgatactgacttttctgataaattgtgatttcagcaatcatgtttcctcttctacacaaaccttctaagacaacttttccaggtctgtaccccgtgtcccctcccccccccaaaaaaagaacacaaacaaacaaaaaactagatctggttcttgtacacacttgaagggggtaaaggaaaaatgttccaagctggcagttcttcccctgaagtctccttcctttatctgccattttccatctgacagagagaacctgcgattgtttttatttccagaaaataattgttggctagagttctatgccctacacgattggctccatttcaacatcatttctagatgcctgcctgcttggggcactaaggctactgctctatccccagtcctgccatataatcctttttttctgttctataaaatggctcccgtttgaattcagagggtctaaaacagtctctataaagaggcttctgttgtagcccactgtcgtgaaacatgttttcagtacccttgaaggttcctacttttgatgaggaatatatttctccaataatcttttagccataagcatatgaatgtggaattccctatataaacatgatggagttctaagagtgaccacgggtcctttactcaaaggaaaaggcttctctgatttctaatgaacgtcttctcccctcagcatgccggagtccttcagccccagtagatgtgttgcaaaaagctgttcctcctcctgcttggtgtggcagtgtgctggcaggtgcagcagaaatgtgaaggggaatgggaggcatttcaggactggcaactgtttaaattctagaggtccattgctaaagatagtcatagtttaaattaaagaagagccatcaactacagttctttctttgctcttaaaattttttgttctctccctttaggtgcccattttacaagtttggaaaagtctaattcaggaaatgtctcctaatgtggttcttggtaaacactgtattctttcagtctaatacagctaagattaagatgattttttgtcttactctcttcactcattgtcacaataaactatgttaaattgcattttctaaaatattttttgtttaattttcttccttccttccctccctccttccttccttccttccttccctccctccctcccttccctccctctctccctcccttcctccctttcttcattcttccctcccttccttccatctttccttccttccttaattccttccttccttccttctttccttccttccttccttcttctttccttctttcttccttcctcatttctttttggctgaaagtgtatttattttacccacacctggattgatagtttggctgatatagaattataggaattgtccaaaacattgacagcttcactctcttataaaattcctcaagtaacatttctaattggattataacagaaatacataagagggaacatattatatgtgtaaagcctaaagaaatttttcaaaaaactaaacatacttattatattccccaaggggggcttgaagttacattaatgtatttgttatgttattgagtacctattatccaccaaaagtgtctatactttatgatgatattctttaagctgagtttggtgacatggttggttccttcattgtctctgaccaggcaagttgagtttctgggggttgttagatggaatttcccaagctcatggagagtaacctgaattgtgttgcttcctcttggcttaagccctggtctagcttctcccatcgtccatttctatgcctttttttcatcgtgcttctgacaagatgtgctcaggctgttggactgccttctagcattgtatttggaaaaattaataatcacagccacaaagtgctgtgacattctagagtgctatagaaccacttaatgctgatggaattgctactgagctgtcttcttcgaatcacatcttcacaggcagtggaggttttattggcagctctggcagatgaagtttgaaatatatcaacagtcagatagattagaaatgggtagtggcatcaccagctttctctcctccgcctttgtcttggtgtctcaaccctgtcgtaaaatgcccactccggagcagagaggattcaagggtccagttgggaggggccagtagctatttgatatggttcagatatttgtcccctccaaacctcaagttgaaatttgatccgcaatgttggaggtggggcctggttggaggcatttgggtcatgggggcagatatctcataaatggctttgcatcctccttgcattagtgagtgagttctcactcttttagttctcaccagaactgatcgttcaaaagagcctggcacctcctcccctttctctctttcccttcctctctcaccatgggatgcctaatccgctttgccttctgccatgagtggaagctcccttaagccctaccagaagcaaatgctggccctgtgctcctagtacagcctgtagaatccctagcccaagaaacctcttttctttataaattacccccagtctcaggtattcctttatagcaacacaaaaccagactaaatcttactcctttcatgttactggttgcatagattctaggtagttcagcaaaagaaactgaaatgaaacattggttttataccggcaacagctctagagtgttggatcatgagatcctgacatgtttgcaagacacattaacatatgaggggatgacacagatcactttaatctcacgatttctcctgaattccaaagacattcaccttcacttcgcctcagtagtccactctcttgatcacacactggaacatgaaaatacttgaaaatgctatgactgtaaattccactctctgacaccaccattccctctttctgtggcccatgctctcccaccacaaccacaactccagccctttaattatgcccttttctccaagtctgttcgttttctcttagcatcagtgaacttctccatccatcttaggactacttacctaccaccttgtcctttctccacaagtgccctgcagaacctcatgctgagcagccacgccatcatagcctcttctacatcaggattctgagcacagctgcagggaaacaatttaacaccacagactgatatcactagaaagttatggcttgttcaagcttcctatgtattccttatattcttaacaaatggccttgccccagatttacagagaaaaatcatcagctacaaattttttcaaatgtttacccaccaccaccagcaggctatctgcattcttgtctactctgcgtcttccttcccaccttagccaaagaggtgtcccaccttctgctcaaaggtacgccctaacccacaggtacctaactccactaatgtgtccatgtgctctcttgtattttcaaaatcacttctttggccattttctttgaaaaaaggggcatgctcaaatctttacatctttacaataatttcacacaattgtacgttccttgctgctggtcttatctccttccattgcttcataatccactgaataaaagagtgatctacagtcatgatttgcatttccttattttcttggcacccttcaagccatggcagcttcccttctttatgtgcctgctaattcatatttcttccattaaaataaaaaatggtctcccaattcccaacctggcactcatctgaatttacatctctctagtattaatgttagcaactattccttctcttttctctttaaaccttgaggctgggtgcggtggctcatgcctataatcccagcactttgggagaccaaagcgggtgatcacctgaagtcagaagtttgagaccagcctggcccatgaccaacatggtgaaaccccgtctctactaaaaatacaaaaattagttgggcatggtggctcatgtggatagtcccagctacttggaggctgaggcatgagaattgcttgaacctgagaggcagtggttgcagtgagctgagatcacaccactgcactctagcctgggcaatagagtgagactcagcctcaaaaaaaaaagaaagaaagaaagaaagaaagacagatgaaagaaagaaagaaagaaagaaagaaagaaagaaagaaagaaaaagaaggaaagaaagaaagaaaaaagaaaacttcagttattctttaagacattatttgcaataaaaactgtatatttatgtaattatttgatgaatactcatctccccaattgtattgtaaactcagtacagggagaaactgtgtatctttgctaaatattttaaccctagttcctaggatatatagtaggtgtataattaatgttaacttgaatgcatggatcactggatgctctcatgaaaaatgtagcacccttatttctcctagagtttcttttccttctctgggctttcctattcagtttccctcactagcccacccttcatatgtgattatttttcagggtattatttttgcttctcttttctcattcttcgtgatatgtttatagagtctgttcattgctgtggtttcaagtattcagtcttttctaagctttagattatatatccaactttttctagacagggatactttaaattcatctcttcaaaagctgatctcatcttctccctctattttcattctagtctcttcttatagctcatgtttcggctactggcacaattagcaatgtcatagcccaagagacctggaagtcaatgcaagccactgctcattcttgttcttcacattattgctgctactaccaaccctgccaattctacccacctaataggttttaatttgtcttctactgaccattcccactggtactatcattacaatttcttgcttggaaaatagttttctaacttgtttgctggtttccaaacttatcaatctattttctataacacaattataattttatagttccttactcaaaaaacgttgaaaagtttctgagtgctttttgtaagaaatgcagaagaattcatggcatccacattgagcttgagtttgccccggatgtctctgccctctgtcctctccctgaccttcagcagcactgggctacttatgggccctgacacagtgtgcattctcacccttcccttcccctgcacagactgtttcatcaatctgaggtgtgcccaatactgtccccctgcaacttgccacctgtaaaactgctcttgcttcataatttagttcattcattatcaactcaggaaaggcttccaaactaacatgtgttacatgctctcctttgcttttccatagaaccctgtctctacttctgctttaatggttatcatgatgttctctaactctgtttgtttctctacctctccactgtgaacagtttaaagggtacagactacatatcctcaatgtctaagacacttggcatccattatatagtaagagataataaatgtgcattgaattagttttgaactcttcattttaatgtccagtatgaaacaagtgggctcctttcccaccaagcttctttttaattttttttaaattttactttaagttctgggatacatgtgcagaaagtggttttttacataggtatacatgtgccatggcggttgctgcacctatcaacccattatctaggttttaagccccacatgcattgtcctaatgctctccctccccttgacccccagcccccaaataggacccagtgtgtgatgttcccctccatgtgtccatgtgttctcattgttcaactcccacttatgaatgagaacatccagtgtttggttttctgttcctgtgttagtttgctgagaaagatggtttccggctttatccatgtccctgcaaagaacatgaactcactcctttttatggctgcatagtattccatggtgtatatgtgccacattttctttatccagtctatcattaatgggcatttgggttggttcgaagtctttgctattataactcaccaagcttcttgactttaaaacatactgaagttatctggagtgaaagaatgaatgggtgctctaccaccttgagctatgggaaggttgtgctggagattttgacacacgagtctcaggaaggccttaactcagtcattccaggattcttgttctctcctgggacctaatggctgctttgggtgctcatgaggtttcattctacaacaacggcaaaagcagttcccagatggcttctctcaccattcagaaggctttgacctggccccttgaactgccagttggtttgcgataaaggaatagagactcattttaatattggtctaagacaatctgctgtgtctaaaagttcctaaaagttaactgtaaagaacttttcagttccttacagaactgaattctctaattcagataattttgaattatccaaaatttgtgcatccctatctttgaacgacccctgtagtgcaggtggttgggaactgactgagagtaaggctgcacgttgtgctatatggctccacaccccaaagaactagaggagggtgcacccttgagacctgattgcaacttccttgaagtccaccttttacacaatggcagactcacagtagaatcaacccagggaaatcatgaggaagatgggcatttgggaacattccacacatcctcatggactgcctccacagcacagatttcctgggcagcaggggcctgtctgcctgttgcctggcaggcatcgccatctcagggtaccatgtctcccccctcagaccttctcaggctgtattagtccattctcacactgctataaagaactacttcagactgggtaatttatgaagaaatgaagtttaatcgactcccagcttcaacagctgtacaggaggcatggctggggaggcctcaggaaacttacaattgtggcagaaggtgaagtgtaagcaggcacagtcctcatatggcgagagcaggagagagagagtgagtgagcaaagggggaagttccacacacatttaaattgtcagatctcacgagaactcactcactatcctgagaacagcaagggggaaatctgccctgtgatccattcccctcccacgaggcccctcctccagtgctggagattataattcgacatgagatttaggtgggaacacagagccaaaccatatcccagaccatgtgtattccaggacttacctgttctataccccgtgtgttcgggaacacactgtttgctaccttattaggttaactcattggtcttgataatattagtagttaacaatactaatggctaacattttgggggtgcttggcaaacactaagagcattgctcttagtgtttgggtttatctccttcaatcctacctcagcccttcgaggtatgtccatgccttgtcgtttttggctattcacagatgaagacattgaaatgtgaaagattaagtaactcagctaagggcactgcactattgaatggtggagctggcattccaagccggatagtctgatgccaaagcctgtgtcctcacccccatgctctaatgggctagcagtgctattgcacctgccccatcctctaatttcctgctctctgcacttgcatgttctgccccaaggtggagtctgccttctcacccctggagcccctctgtcctgaaaggcaggcaggaaggactggggctggatgcatgtccacccctctcccaaagcagctccctcgatgcctttaggacttggtgtgcacacattgcagctccctcgcccacctccagggcaataactctgaggagtgtgttctaccctggctccaagaggtccccaaataggatgaagtcccattggcttgcagcagttgcttttccgactgtgctgtcctttatttcgcaaataagcaatttgtctttatatcctcatctcagtgtctgcttctttgagaatccaaactgaaacaaatggcttgctatgtcacccactcccagatcccctgcaaaaaattccagtgccctaaagaaagtaaagactgacactgaggactggagccgtgtgtttggctggcttctctgtctttccagaggcccagctctgactttctctgcctctcaacattatctgctttactcattttcttaaagcagatgcctggtcccctctgcagcgccttctcaccttgctgtgaacacatttacagtaagtcactgcaccttgctctgttgcacctggaagaataaatggttctcacctctcctccctgggatcaagttatttggtggctggttattgcaacaaaaataactgcaggtgaaaatggcaaatcagctcactccactcactgttaactcacctggaaacccagcctacacctttccaagaaaggctgtctccgtcccactgcaggaaccccactccaggcacttcatttggcctattttttgagtaccctctgggtttggagtactgcactagatattctttcagcgttgtaactggtgttagaaaccagttgctctcaagaatatcttgtttgccctgagttctggactcctgcaagtttcagtagattctggagtttcacaggtctctccaggcttgaagaaattgcctgcagcaaacacacgatgagctccccatttccccggcaaagacagtccagggaaagagaagaccaaacagagacagaaagcagagaccacggtgtaacatttgttttcattgtactgcctgattttgtttgacttatattttttactatttttttctaaaatgtatttttatttcttttgatctgccaaaaaataaaacaatcacaagcacatgtataatattccctttccaaaattaacagccagcccctcagctgcactcggctagtgtttatctcaggcacagagcagttatgcagagagtgcagcaggaatcctgttatggactgagttctgtcccctccccttttctcacattcataggtttaagtcctgatcctcagtacctcagaatgtgacagtatttggagaaaggacctttaaaaagaggtaattacacaattaaatatgatcataacaattgggccttaatccagtatgactggtgcccttatgagggcaaggagaggcaccaggaggcacctgcacaaagaaagaccccatgaggacatagcattctccatgtgcaagccaaggagagcagcctcaggagaacctgtccccatggatacctggatctcagactcctacctctggaagtgtgagaaaataaattgccgccatttaagccacaccgtctgaggtgctgtgtttcagcagcccgagcagattactacaaataccctgtgtgcaaatcagggcacttggattaaaaccacaccaaagacacttaactcggtgtttcatctttagaatatcactttgccgctctgaagctccgttttcctctcctggtgatgtggtaatcgtatcattctctaaatcttcttcaggtgactcatgtacaaaatgtgtgtgaagggaccctgcacacaggggctagcttacaggggctcaatacatcttcggtgatttattttctgagaatgcaaggagtggggaggattcaaacttcttacaatttagctgccatatgtcataaacatttatgagagtcaagtaaaaataaatgattgattctaagtgtgcaagacaaagagatctaaaagattgcagaaaaagatgttggtagatggttttagctgggataccagggaaggaccttctgaaggtgggcctcaagctagcccggtaggataggcaggatttgaagggtggaaaaggagggaaccgcctgaaaaatacatgcgtggaagcgtggaagttgttggcagtgggcagttctgtggttctgaggatggcccgcagtgggtggtgaaccatgggagatgaaggtgtgttcctgatggcggcggggagtgcaaatgctcttcccttcggatcttgggaaaatgtacctccaaaggaatccttacattaggagggaaggtgaactacattacctatgatctcttttaactataaaatttcctaatagggttaaaatgtgagcgaaggctagttaggtatattgtggaatttagattttgtcagttacataactggaaacaagtgaagagctttgtaaatgatatgatatatgacgataaaacatgcctacataattaatctgaccatatgctggaagcatatgccaaggataccatttaggtgcacaatggaaaaagaaacttagtgcttagctttggctctaccatttcctagctgtgtgaaggatcttaggaatctggtttcatttatttatttttgtacatgaattcatttttcgggaataattcagtgtgagcttattttcttccatgcacactcctgagcaatgtggaagtgatagaaaatagttactgatctcatgtatctaacaaccgagtgttaacgatggaggaagcattggatgttacaagagttaaagaggacacaaaactagtcttcaggattcagggagggcttccctagggaggtggtgtcaagactgcccctagtaaatgacgtcagacatgcacctaagcatgagcctccatctctttattcatcgagagaaagaggaagggctgcgttttctctgcctagttcctcaactttctttaagggcgagtaagataaatggatggaagctctaaaagctaaacaaatatagggtagcctgctttaaagaaagaattggcagagggtagtgaccgactggatatggaggaaaggtaaaaagatgcacgggtgctgactttgttttttaacctggaggaataaaagatttgagagactttctagttccttgaaattaagtctaacgatttgggatgtgatatttgttgcctaaggagaaggaggtgatgaggagaacaacactggatgtgttgactttaaggtgacttatgatggaggcgattgaaaatataggcagggtttagctagagaaagaggagtaatctctatagaagtaaagtcatggggcaaggtcagtgtttagacaaagacatgtaaaagagcattctttatgttatttgaaaaagaatgttggagtgttggggttttgtgcctctgaggcctggtgggccggctgctagctgttgtggtccatgatggggatacatctgagatgtggaatgaagaccaggtgagccagatgagggacaaagacatcacactctaacacgggtgtctggtgcggtgaacaatagataaggatttgtaatctactctttgaagagccatgtgtgggaagaagaaagcaattgagtcttggggaaagcttagccttggtggacagaaattaagcatagttgagggacgataaatacaacattatggatacatatccttaacatgagacagatggcagggaagtctgtttttttgcccctctgtttttttttttttttttttttttgccccaagtgtgggagtattcattcagtccattctagaggagacttatttgcagaagggaagcacacaacacagaggctttgagaggaaggcagagctccctgggaggcctgagcagcacgtacattctaatgcttttgttggagccattttcaattatttaatgaataattggaatctcatcatttccttgatttggcaaatcgaaaatttttttccctctagggcaaaataccttcgttttattttcttctccataattaagtaatttcttaattagtaatgttcaacttatccaatctgaaatgacacattttattcctttttataaaagcttgcgagcacacacacccagcccctacctggtggtggagtgcttgtcattcctgggatcttttgtgttcctgagctctctccatctcccgctttctctggcatctccagcagttcttcctgagcagtggggaaatccagctgtgtcatctcacactgcctgacttcctggtggctgtaattagcgcgaaggagtttctcctccgtggggatgtcacaccgcgccatggctttgcacctggtgggcaaccttactttttggtctttctcacttggcaggcagcgggtggggtgtctgctgcagaggctgccctaagttggcctgtgctgtgacattcctgaagcactttgcacctgaggctggggctgaggccctggctgcagggagcacagctcccccaaggcccctttctatttttgcaggctttttctctctactccactaaacccagcatcaaatgtcactcccctgtctcagccaactgtagactacagaaaatggtaggggtccaagcaaggtctggtctgtattggactgaacacctaatttaagagctaagactgttcatttccaaggttgttgcatcctccaccaaggctggcaaaagaatgtcagacatctccaccaagcagctcagtcaaccagcgacatctgaccgagtacttggtgtgtgcctagcttcatgaaagccctgcaaagttagcgggtaattcccaaagaaagtattatctagtgcactttgtcagggtccctcttacagacacccttcccctgcacacctgtgactgcagtcttctgagttgactttgacgaagacctggctgggatgaaggagagcttcactccccattttcaccggttgctactctgtccccacccaggctgcctagggccagggagtgaggacgataatgatccagcactccaatgatgcacaattaacgttagagtaatagaacaataatggctgcctgtggtagggactttgaaatctccagatgaaaggcccacagaagtacagtgggctattatcagcatttatgtagcgcatttcatcttcaaagcactttgcaaatattaactaatgaacacagaatactgtcgtttttttccccgaaggactgggaggggtagcctctgatgagagtctgggcttaaatggaaacattgctttatgactcggagacagaagtcacattgctttatgactccgagacttcaggcttcttagggcgggaggctctgatgaccagggaagaagcctgcacttgcaggtgggtgggtaggacactggagcacaagccaagccaacgctgtcagcagaagcactgcatacacttacgtgagccacaccggtgattctaagtttcctagaatcacgttttaaaaaatagaaagatatgagtgaaattagtttgaataatttatttaagccaatagagctgagacattataattgtaataacaagtaatcaacataaatttatcagtaaatagtcttttcttattttacatctttgtgtaccaagcctttgaaatcagtgtgtgttttacacatagagtacatctcagcatggaccagctgcattgcaagtgcccaacagccacctatggagagtggctctgtatacagcagcacagatccagactgcctttgaggaagacagcccagaacgcctggtcctgctatccgggactgtcactcacagcacagggtaatacagggtcaagtatatggtctatagtctgacagacttaaaattgatactgattcagaaatactacttgcatgacactggacatatgatttaatccatttgagttcactctctccatctataatcaaggaatgctactagccgcaatgtcacagttttataagaattaaatgagattacttttgtaaagcacttagtgcagtgactagcatgtaataataacgcaataaagagtagctattatcatatgaataggatgagcttgtatttcagggccctggctctctcccatcctcctctggcaccaggcgcatcctagttccaactctgcacctggctgggctttggcagtggggttggtagatgaatttcctcagccttaatgcctgtgtgatctgtgtttgcacactgatatatgcttatatgtgtgcccaggaccaggaggctttagagggtcacatagtttgaagagaggaaggatgaaggggaattatttctgcaagcccctcatcccttcaattacctctttggctatgccttaaggaaagagtttagaccctccataactcttggctgcctttagcctaacaccctccctcttgcaatgatttggtcctctaaaagtgtcagaaggtcttgcatcccctttgttcactccattctctccatctagaaagttgtttccctccctcaactcacacatactgtgttaactgtagtcctggccctggtaatacctcactgcacttaaccgttcacagcatggcaaccagagcacactaacttctcaagaaatgctcactgaacccttgctttgtccacagaaaagtgatcaggtgatgggagaagatgctgtagcagccggggcatgtgggctccaccccccaccccagggtgtacaaattctgggtgctttcatctgaagcacaacctttctaaatgttgtctacaggaattccttcacgttaactcactttgaaacaagaagcaagagtggaaatgtgggctgccctatcattaaatgatcgcttctggaaacatctttttggttagcacttcttaaagctcagctcaggcagaggactccttccccatgtttgaaatgtttgttcctcggtgctgtaaagaaacagcacttgaacataaatttaatttatttagtaaggccatttttacttcctgcaggaagggtacactcaccagcagttttgccacgagagtacattgaacaaaggagacagggtcatttataacctgacgcatcctccctactgctatgtccggtttccactagctggaatgggacctcacattctgtatttgtcctgactggctagcaacttagaacttttcaaaagaggcaaaagtagaggagaacaaaggaaggaggaagtaacttgtagaatgctgagaaaggtaaaaacacttttaaataaggaagaggaacaggctatgacctaatgcttgcttggaccattataagcatgccagggcaaatatttaggctaaattgtgggagctaagaacataacatacattgatttctttattacggctagcaggtatttaagaatgttagcacaggtctttgaataaattttgcttctaagagaagttactatttattcctaattagacggggagacaagtctttgaaaaggaacctctactttactttttacacccacaatactaactgcagtcgttggcccttctccatggcttctgtgacttgggatactcatggtcaattgtggcctgaaagattaaataaaaattccagaaataaacaatttataagtttaaaattttgtgcgattctacgtagcatgatgagacctcgtgccgtcctgtgccatctaaccccagacatgaatcatccctttgtccagcatctccacactgtctatgctgcctgcctggtgtcaattagcagctgccttggttaccagatcgactgtggggattatcgcagtgcatgtgttcaagccacccttattttcttaataatggccccaaattgcaaaagtagtgatgctgtcatatggtcatcattgttctattttaatattagttgttgttaaacttttactgtgccgaatccaaaaattaaacgttatcacagggatgtatgtataggagaaaacatagtatatataacgttttactaccattctcagttttaagcatccgctgggagtcttggaactatcccctgctgataacagggaaggtattgtattcgaatcagaaggtgctttcatgcaaatcttgtccaaccctcccatttcacagttgaggcaaagagcagtcaacttcttgtctgagctggtaactgaatccagatctgatacctgactccccacccatttgttgtagctctgagttaatggctgtgaatgaccttgaccagaaaatccaggtatccctgcagtaggaagctcttctggggtccctaacgggtggtttaggacctcaaggagtaattttttggggtctgttgagccagcgttcagtttcctaacagctttacctcttgcagctcttacaggcagcagctgcatgcaatgtgttctgacttctgccatgtcttgtaaagcagcttgggtgctggtgctgacacaagcattcctcgttttgctgttgtttgagttgaatatgtttgattcctttctagttgcttttttcttcccttcccttctcctcttttccctttcttgtattttatttccctgcctttgttctcattccatggtccccatgtaaatatctggtactagagttacataaataatcaactgcctcttaggagagagggatgaaaaacagtaaggattcattttcctgagagctctggggtatctgactaactggcccacgttggtctcttactgagggttacttgcctccaggaattgcctttgggggactcttcagaggaaaacacaaaagcacaaaatgcaactgaccaattgtgcagaactatttgtaggaaaagatagtgtggttgggtggggaaaggaattctctgtgacccctgaggtggccagctaaagccgcggagcccctgaagcatgaaatttgattacccttatctcggtgcacagctccgatactgctgtcggtcattcaattacccagcaacctctacaaatgtctgcagccgcagttaatacggcattagggaggaacacaccatcttccttgtgtggtacctctgaaatgccaacagaccatccgcaccatggaaataggcttggccagagacgagcctggactttgatcattactcctgagcttttctatcaatgattgaatgcttctttgcctcttttaagataacatcatctcccttttcaaatcagatatttcaaaatggcttggagagatccgcaggtgattatggagttaggagaatgaaaccactgaagaaaggctagagaactagcatggtttaacttggagaagaaggctgaagagtgattcaataactatctgcaaatgtatagaatgatgtatgaggagggagatgactagctgctctggccattctctgaggccaatacaagaggagtagtcacggccacacacagtgctgagctgcgccatcaggaggcctgtgcccagtctaggcctttccaagaaaagtcctctgcaagaccctggccattcgcctttccttgctttccactggatgacctgcttccctttccatgtttgtaatgaatcattagaatggtggttaggtttaaaaaggccaagtttgtactgactgctgtggtcctgcctagagagagaagaagcctctaagtaatcctccaaaaaggttttagggccatttccagagaccagaggtttggttattcatggaaagaagtaaaaactgtgttttttttttgttgttgttgttgtttggttttgctttttgtttcttttttttttagaaaacaaaacaaaattttaaaaatggatctggaagagtaggatttgggaagcaattataagtttccatcaatatggacaaaaagtcaacaattctattctaatccctctctttataacaatactcccattgtcttgttgataagggaacatctattttatgacttctccaatctcctggttaatgcagatagctgtttggctctgcaattgttacattatctaacatagctggaacagtgagcaagttagagattggctgcctggtgttactctggagcttgtcagtggggagctggtcaattggtctgggcagggggtgggggatgctccatggaccttctagttctcatctgtggagaaggaaagacctttcctctactttctgagattctgtggctaaggcctatggatgatgctgacaaaagacagattaacaggagaaaagcatgcaaattttattggaggttagacatttttacgggcaggggcttcataggaagaagtgaaaaccctaatgaagtggctagacttgagacttatataccattttaacaaggagccataaaatgtggagatgtgacaagacaaaggataaagggatttgaacaaggagtagtaaagtggggttgactcaaaactatatggataaactaatgagcactaaggggtgttttagttgggttgtttcaaaattatatggagaaactaatgggcactaagggtgttttagttgggttgtttgtactaatttaccatggcattgactctccatccccagtaacaggagcattctcctcttcctggtacagggagggcacctttctcttatgccctgctcgtagacagaaagggggatggcagagaatccttcccacatctgatgtttcccagtttccttcagctcaaaataatcaataggccaaagtggcatatttggggatggcacgttctgatcctctgaacatccttcctacaaagggtggtatagcagctgggaggtgcagttgcatcttctccccagtctggaaactcggcccctcttttggtcctcagtttctctggatatattttcacaaaggttgctgttgatcttttaggaataagcttagctgctacatgtccaggatagcatttgcaggttaagtattgcccactgatgtctgcaaaaccaagctggaggaagacccaccccccaaaaaagtccaggtacccagttccatgacagtggaagcaggtgttatttagctggagtcaaacagcacccctgatgccatcccaactacaaaggcagtatattctaattaactgcaaatgctttgctcataaagctgtcagcactgggatctaatgtctgtacttttaatgatgcatttgattagaaggtaattttattcacttggtggcagtccgacctgtttggtgagggtcgcttttcccctcctctttcccccactttttctctcctatttgaaacatttatgaagttgtgatgctcaaaataatctaataagtaaataagtaaatccatcaaagcaatgtcacaatgtcttctcaccaccagcctgtgtgggtgtgcatgtgtgtgtgcatgtgctgtgtcacataacaggataaagtgaagagtgaggtggttttttttttcttttaatttcacatgagattcacacctggaatctcttcttttataaccttacattctcttcactttactccaagtcctaataactgtcatgactttataatgcatcacactttgcacattgtttccatgttctttcatgtcacttatgcctcacaataaagctatgacatagttctacctctgatgaaggaacagaaactgggagattttattacctctttgagaaactcagagtaattcaggaatttaaaactagacctcagtctaaactctgcgctttctctaccacaccgtatggtttctcatcaaagagtagtttttatcttttttccttgagaaccaagtacggagctgcccacactagaaattcactcttgctgaaggacatctggggagccactggggctgggttcacaaagcctttggtctgtctgggtcatgccttctgctatgggggcatatggtgaggttcaaggcaactaaaagttcagagttctgagtaaatccagcagccttcagtgaatttgtttcatctctcttcctctccctcgtccttcctgaggaggctggggagtcccttccttgtaggatcctaagccttttacatcatgtgtccattgcccttccttgtaggatcctaagccttttacatcatgtgtccattttaatctactgacttccccactccctgcctgcttctccctcccctctccttactttccttgccccttctcctttgacaataagagctcatcttcatggagggcttactggttgcatgttctttacatgtgtggtctcatttaatccatgtgtaatgtaggtatagttatcaccccatgaaggaaaccacatctcaggaggttatgcatactgcccaaggtcacagagctggtgaagagctgcaagtctgacttcagagcctaaggtctcaattactgcttgtgttcatcaacatgttgctgggaggtatctgctgtgcttaacactgagctaggtgctgtgagaggtgccaaaaacagatgggagatgatgccattttcaacttgggatctcaggagagctctgccctaaaattacaatgaaatgtttttccaacaagacgtgacatcttcacctaggaatcttaaaacaccgtggggtgcagactgccctgtgctgccaactctcaccccctctttttgaattgaaagtcagtaaggttaagcagttatgacatgtgaagggatttgatcttgggttttggggtacaggggccattcttttccccatgctgctacactgcctgttactcatcaagcggtagaagaggagagtcacttgctgtatccaagctggagcttaattttttatcctcaaatgtttcatccgcagctactccttaggtggctgattatgcttcaatgaaatctccatttgaaggaaaatcatatcgtatgttagaacagacaaagggagagctcatgaccttgcattgcttctcattctgcctccttccttgatattctcttgtgctgctagcggggaatttgacacattgaggcagacagccccttattattaaatctgtttgcaaatgtgtggaaagcgccctgcacaccctccctggttatgagaggtggcagatccggtgtctgaatcacaggctcccagaagtatttgccttcccttttcttctcccttttcttcactcagattgtccacatttcagaaacagtggggatactagtgccagatctgcagagccctggagcagagtcctgcaacatggaaatgcggcactttgcgaaagtagacagctcaggaaaatgggcctgtcctcagtgaaatgggctccagctggccctgaggtgctgtgatggggtggccaggctgaggctgctccactgtctgcatgccatctacttttatgatgccttttattgcgtgcgactgattaactgagttatggccaccaaacattctaggaatgcgaagtgccagataaggtcttgttaaaagtaataacttcataaactaagaaagtttgggtgtggtgggggactagagagaaaacctcttgtttcagttagggttcaaggcctgtgcttttgttccttaggtcagcatcccttctgggtctacaggaaagttgagaaaggggaggcagaaatagaaacgagtgacagcagctggctgtccagcacctcgccttgaccataggagtgggagggtgaatgcctttgccacaatctagggcttatgaaaggctgtcacttagcatttgtacctctgcccatgagccccaccagcatcaccacgcttcatgacaccatgagccaagatgagtgttcccctttccactgaatttggcgagtggtgtttccacacaaatgcgaaaatgtattcagttcttcattcattcaacaagtatcaccaagcagctaactgtgtccttggaactaaactctaagaccacggtgagtagaaatgcatggtgggacgcattgggaagctttttcttttttaatcctttaaattgatcatttttctgcttctggataaaaatctaagtagggcatttttatgaaatatctaatagagtcaagctattgccttgggcacgtaagtgagaatacgtgcatacagtagagcttattagacaacaaatgatgtattcacgccacatgtacatccacacacacacaataaaactgaaagggaaatacgcactaactgcgcacagtaaaggctttggacaggtctgggaagacttcctggaagaagtgaaaacaaagtgcggtcttgtgggatgctgaaaacttgtccagcagttcccccttaccctcagggaatatactccaagccccccagaggatgcctgaagctgccaacggtaccaaatcctgcatatactatgtacatcttttttttctttacagtttcacagatttgttgttactgtagatcttggtaacctcagcatacaattttttttgtcttcctattaatttgagaacggtgagggaaaatgcatggtgggatgcattgggagcccttttcttttttaatcctttaaattgttcatttttctgcttctgggtaaaaatcttagcaggaaaaggaaaatccttttcccttaaaggaagtactttacagcttctctttgacatattcaaactgacaggttttgagccattacgaagtcaaataagagttatttgaacacaaacactgcaataccaagacaattgatctggtcaggattttccaaataatattttcagaccatgccaaaccacggttaaagcgggggactaccgtatttaagaaataaccaggctttggttcagagctgccctccaatcatgaaatgtattttaactgaatgctgagcatcctgtccttgccccgggcaacctggtaacagcagcttttaacaaaagaaaagcaattaaacaggcccagctggctctccggggggcctttgctgtccctttcatgccctggcctgcttctgtgctgggcctgctccaagatgaatatgaagcctcttcctagttttggattttttctgataagaaggcctgagcacaaggtgcagaaacttaccgagaattacgcggtgccactgggacactttggttttaaattgagacctcagcacataaaaagtctgccacaaatgctgaggtttggcttcagaaattaagggctgtcactttaaactgatttccttttcctggacctgctcctcttggcccagcttgggcagaggagaagggatattttaaagtgacaggtttaaacagcctccgcgtgtgcggtgcaatcatttttcatgcgaagcctcctgggcccgtgctgaggggctctgcaggagccaatctccttccataaattcgtgggaggccccaagctgcctggcagcgagagcagtaggaggggcagcccaagcgggggcaggtggcaagaagcagagctctaggacggggaggcccggcagggcgcagcgtcctgggaggggccacacgctttggcgctgttgagcaccagcgggcacctcggcttgtggctggcccgcgaaggtgctgaagggactgtggatgagtttgaaaactctctctgagattctgtttccatgagctatagcggaaagaactggaattagaagcagaaaactaggaatctagtcctgttttgttaagtgtttatgtatgctgtgtgaccttcaccacatttaacctttatgaacctcggcctccaggtttccaactgtttctgtctgtaaaaccggggtgtgaacacctgctatgctcacctcctcatgttattatggggaacagctgagcgggtgaagggaccatgtcttgtaaaatgcagtgcggtaccagtgaaagacgtatacagtgtcacggcagcagccacggtagaactggaaattgcccagcatagcagtctctggccgcaattattcagagccagcacaataattaatgaatgggacatctcccatcccaaggacaaaggtctcccaataaagatgaaaacctcacctaagaagttggatcaacccagccccagctctcagggcagagtccccaggttcccagacttggtcggggcactccactgctgctcaggaaatggacactggtcatgtcgcgctctgggccaaagcctgacccaacttccttttgcatgtggtcacagggcccagcgtttgcaccgcagggcatcttagcgattaagtcgaatgcttctttgctgggacccctaggagactgtaactgcagctcctggcgatgaaaaggcactctctggggaggcaggtggcctcctggctgctgtctggctttgctctgcagatgcccttcaccctggagggccactgcatttccagacaaagaaacagggaatccagcctgagggggagaatggaacggcctttttttttctttccttgatttaaaatcctgtgattttctgagcaattcttaggttgctggctgtgcttcacagccaccggtatatttaaagtttcggtattaaagagctcagcagcctctcccaggaggaaatcacctccccaattcaagtcagccaggtgccctcttgagacgtgtgggattcgtgtcctcagcaaaaacctctctcttttcaaactgggagatggcagcacaccgccctattactggaatagacacatttatgaatttcaacatcctattagtggtgatgatctgacaaaatcacaagaatggagatatttgggtgtacagctgacagctgatttatgtgcttagatggtaccaggatgtagtgtgcctccaaagaagcccgtgaggagccggtgcagggtgcggctggggtgaaacagggatcccatgcctggggcacaggcgccatcctcggagttcacaggatccctccggggccattggtatccactcagctgaggcagcagcacagagggtgtgcaggggcgaaggctggtgaggacagcacccccccctaacacgacggtctccttgaaacaggttcgagctgacaccggcacatcagccgaggcaaattcttttcctcagatgcaataatttaactggaattgatgaaatgaaatatattttggaatcactatcaatcccagtgagactggctcatgacaagagtctactgagctatatgtgtctatgagtgggtgccaagggactctctctcagggtgctgggtggacgtggtccttgctgttgttaaactgcgctggtttgggctcctctgggctatgttgactgtttatccagctcctcctcctctcccctaggacagagttactgtgctctttattggcttttgtgccctctgaagctccctctgtaagagaaaaattgaattggtcccattagcttgattttagtagtgatagagaaggtaatggattcggggcttgcttgccatttaatttagatgttaaaatatcacatgtgattaatctagatacattattgccattgccactctgagctggccatgaacaggaagagatgccttcaggtcatcatttaggaagtgtctagttaattaagggaagaggaccgccatgtcgggatggaattccttcagggatacaagaaagaggttgggaggagtttgtcatagtaggctctttggatcacaaccatcagcatttgactgggtaaaaagaagggggctctgtcctggctggagtggaacacccctaaccccccaaaaccataaatacgaatcacggcatttttagaaccacagattatagctccatgagggcaagagccaaaaatgaggttaaccctgtgtcctccaagtctactccagtgcctgccaaggggcaggagggggagtggagttcaggtggtgtggagacatagggaatatttgttgaaggaatcatagcactggaagaaaatttggggtacatccagtcagtctatatccccgcttaattatctcactcatagagggctctgcagtgaccacaggaaatttcaaatcccagctctgtcacttaattgctgtgccaactggtgcaggtaacttagcctctctgtacagttccctcatctataaaatgtcattcctaataatacgtgcttcatagggctgtttgaagactgaatgatgtaatgcatgggaagctgtttgaagaatatttggtatctatcataaacacttaaatgttaatcactatagttactacgtgttgtttccatcttgcttttcattaatccatccttttcctaattaagactagaaacttcataagagttctaaatccagtttgccataacttaaggccctttttcctatactggcctcacagaggtaacacaaatcctttatcaaaactacctgactgagtgcggataagtcctgggctctctgtaggcctcagtttttcttttgttttgttttgtgtatgcagacacagaactagatgatctctagaggcatctttcagctctgttgtggtgattgtggccagtcatggcagctacgcttactgaacacctattatgagctaggcactgtttcaagcactttcccgtgttaattaatacagcactcgcattggggaatttgatatcagcaccttcattctaaagatgagggaagcgagctgctggaaggtcagtcaggtcacgggccgagggttgcccagctggtaggcagaggtgccaatgtttggatctaagaagattcactactcagaccatgagcctatagagctgaattaattctgtggttttctgttactatgattttgagaatatttctgaactcaaggtgaactgagaaatcagaatctctctactctgttggctttatccagtgacctgaccttggcaccaaagaatattttccatccataagtagcaaagtgcctgattgccaaataaataagagaatatgagctactgtgaaaatgccccaacgagctgagttattactactgtgtcataattacagcaagaataatacacatttacagagcacttcatgtcccccaagtacttcatggctgtcataatgaggcagcctattgacagattccaaagagatgactgcaagcgttgatttccactcttcagtgctgtgaaacttgcaggtacctctgagcttgggatggagggtcagggaagagatatggaaaagccaacaaggccaagcctaggaggatgatggaaagaggattaccacctaatggtgagaaaggcagtactagctccaaattccttgggactgtataaatcaaaagttaattactggtaggacccccatttgtactttcattgctctgtttacattttatgaagccatctgttatcattaatatgttcaaagtcagttttgttttatttgtaatgatacagcaaaagaaatagcaattcttcctcaagtgggagaaaccacaggcctggggaaggaaggcatctggcccgggtgagcccttgcctggaatgacaaccatctctttgggctgggttcaggcaggatctgggcaggctacagggactctggcagctttttgcaggctcagtctcttggagggaagcttggccctctaagctgaggcataatctgcatctctgggatgtggataacttgttaagagtggtgcagtgacaggctgaagaacagcggaacaagcccaccagctgcccttttcgggcacggagctgcagtgaacccatccaagatatcaccatctccaaccaggcccatctgcaggggcatccctggggccacacacatggatggagcgtacaagccatcttgttctttttctcttgtttcgcttccctaggacacagctgagtgacccctttggaggtggcttagggagaccagaaaccaccaccggccacttttggctcggggactaatggcaaagtgctccttcctgatcccaacccaaaatgagcagctgctggaggattacaaagcattggaccttctcctgttcattttaaatgttatctcagctgggcagttcttgcaaatgagtccatcaccctccccttcctctctagctccctaccatcaccaccacacactctacccaaatacactcgggccaaaaccagggcctacaaggagtgcacattaactaaattgcagcttactggccacgttggtggtgttcccagattgagttcctctggcttaacactcagatgctaatgacaggagctggtgggtcagatgtggccaagggacagccttcaaaaataaaatggcaagagcgggcttcacagagcttcgattttaggctagctcactggcccgcaagtaaggtaaggcagagatgcatttaaaacaaaacgaaacaaaacaaacaaaacaaaacaatggaaacatctttctgccacaggaaaacttgtacttcataactgtttccaatcataccctgaaggtttcagaaacacaaaacaaaatcttttattgattctgccgcaactggaatgtggtttcctttctctaagtgctcccctggtgcagtttcttgcctctgacccccgtccccatatttttcccgactatgcctcctcctcccctccagttttttctctgctaccagatatgaatggcagaggaaaggattagaggctttggacaggaaaaagaaacaagaaaaataaaacaaaacacggcacctgcttagtcgtttctcccaaaagctacagttgattgggaccagaaagaatactctgtccttcttttcctatgtgctgtcctgttcctctcctttgctcctcattagtacccagaactggttgtaaaggacttttctgtgcaaagcagactcctgttagaagccatttccaaatctgaaatcattgcactgggcggtgaagacagacaatggttaggccactgaattcactaaatggacattgggtaattgagacacttccttctggggtcaaggactgtggtttggtgctgggtccccacccagggaggcaccctcacttttggctgaactggttggggtgagggctgcccacgtcttggtagattctgcttcttgcacccatggttgtagttctaaggaggtgggagatgtgggattctgcaagcgaaatctaaatgtcccaagtacacaaggctgggacctggggagggctaatcgggtacttcttctcattccaagtgcttcccagcctgctctttcgtctcctcctgtcactgcagagcccgtgtttgattaatgacagggctcttagtccccggctcggcccccctttgctccccccacctccacgcatgtccattttaattctctcctccctcttttggcatctggtttattttgtatataaattgctgatgcaaatgtccaaaataaattatgctgaataatagatgaagacagctacataatttataatgctagaggccagacagagctggacgggctgagttcaagcccatggccacttcccacaacctgctgggctggtgtttatatccttaagtgctggaaacaaacacagcctgatgactgtagctcagactgtcttcttcgaggtgtgtgtctgtccctagagtggatgtggtctccccagtccaggctgcagcccgtcagtgaggagcggccacaggaacagcatgtgtcatccccttcctcagctcgtcctgttggctttgcctttaaaacagaccccaagcctgactttcccccataacctctgccaccactgccttggagaagccactttcacctcctgcctggcgagtgaacaaccaccctgcatctctgaaacctctccctgttttctcctttatagctggcctgtatggctgcagctttagggtgcccttccactcaccttcacatggtgacctggtcatctgcaggcccctgaatttgcatcttcttccctgtctggtctctacagccctgcccatccacaacccagcagccatccttgagcatctggtcctgctgggcacacagtgactacagggcatagatttggggattctgaagcctgtccgattactgccctgagcttgggagggtatacactgggaggaactagagctggcattgacaaatgggaagagaaagcttccttcagctttgtcaccccagaaagccagttctgctcacataagacatcttcagaagaagagaacattagttatttttcctgatccttggtgtctgctctgataatcgagaattgttgaaatggctgagatcacaacatcagtctgattggctaacaggaaatctgagttgtgtaattatgagaccaaattcacacaggtcaaaactcattagccaaagtgtaaaaatagccttctgtacaaatacagcattctctgcagtcacactcgctcagcataattcccttctcacctcaggataatccagaggtgaatgcagcaacctcctccccgtgcacccctcacttcctgttcagagacactgccttgcaccttcacacaggggcgggtcttggacgtgggagttgtgattcaccggtatggacaccacagaagagcttcagcgtttccgaataccccccaccatggacgaggcactgtgccagcacatgaataagtgctatcaaattgacaccttaaacaactcagggagctagtgttagctccacgttacgaaagaggaaactgagtctcagaccaagcgactttgctcaggtcatgcagttgttatgtgaaggtgagaaaggggcctaggatgttgcagaaatgatcagggagcatgagactgaggggacccagctttccctacgaaccaacctgcttcgaccaagtcactctgcagacagaatgtgctatcctcaagtgagcaatcaccttgtcactgtgccatcacacacggtggccggctctgtcccaagctgctaagggggtggttgacggggtatggccagccaaagactcaaaagtgctaatagactttagctgtgtcatataaagagagagcagctgcactcaagaaggcctctgagcattacaaaatagtttggggatctaaaaacggaaagcgggttcaggccatgaagatggttgcagaattattttagattttcatttccgacaaaaaatggaagggccatacagccgtgagattagttccgtccaatttcgagtcagtgacgcaccactgaggcctggggatcttccatggctaagcagagaaacctgaaggaaacagttctccaaacggactcgaacgaagccgggggctatagatcggggggctgttaagcatttagaggctcccgaagctcctttggagtccagagcttgaaaatggaagagggggcagaaaaatggaggaagtgagggagactttgctctctgagacttttgggggagcatttagtggtggtagaggcagtatacatacctgtgattttaagacctgaagtaagaacatcctccagaaacacggagcatttgctaccacaagcaggctgaaagtgcctgcgttccttgaggaagcatgtgctggcttcaggtctgcaaggcaaagggacattcaagggagacctctcctcctctgacctctgactccccaggactccagagcctgttcactgcctctcccagaggctgctgtctggcagcagtagagccctgggaaagcaagggtggccttcatgtggaatagcagaaccttggcatgagaacctgtgccctcatctccttattttttgtcctaatggacttcttgggttaatgcctgcagcacagctcctgctgactaatgtttctgcaaaaatcagacattctttgtgctcttcctctcagagaccagataaggaagccactccctctcctgtctggcagcactctactaggacctggtgtctggtgcacacctgcctgggctcccaatgtagaatccaggggaagacactcaagtaccaacctccactgccagtgtccaacttcccagctgaatgggaagggtgttgaagcttcctcaacagtcttagggttgaaggaatgaatgatattataatatttggtgagggaataaggtcacagcctgtcaaggacacaggttaacattaaatagaaaagatgttactgcaactatctctgcagccaggatctggttggcatgagcagtgagcagtttctcaatcttagcgccactggcattttaagttttatactttacaatcacagtttgggaagggggttctgtgcattataggatattagcagcatcgctgacctaccaaatagatgtctgtagcacccccctccccaaactgtgatcataaaaaaggtctccaagcattgccaaatgtcctccagggggcacagttgtccccgcttgagaacccctgagttaaatgattctgggctcctctgtcaagggtccccaaagtgaagtccttgggcaggcagcagcagcagcgcctggaggcttgttagaaatacaagtcttctcatcacactgcagacctgattcagaattcctgacagtgggacccaggggatggattatgtttcaacaagccctccggatgattcttatccatgctaaaattcgagaagcattgctaaatggtagccacttgccacaggtggttatttaattttattttattaactagattaggcaaaactaaaaattttagtttctcagtttctgtagccacattccaagtgatcaatagctacatgtaagtggtggctagtgtcctggaaaggacagttacagaacattccaccattgcagaacgttctgttggactacattgtaatgaagttgctaccaaaatgtggacgacttcaagaaccctaagactatttctggctatcagccaagtcctacagaatactcactggctaacttatggcactgcaaaactagatatagaagtgaactgagagaagccgtgtttcttccccagtcatgcttgcatataagataggtatcatgccactaacctgcccagagcccatccatgataatggtcaaggcagctggtcagagacacaggaagtctggagtaaaacgcataatatagagcacaccttaatcttactttaaggcaatatgctaaggtatcaaaataaaagcaagcacaaattcagcaaacacaccagggagaacaaaggattataggcttatgggctcaagtgctttgcagggataccaggttttacggtggtatgacagagactagcccattctcctgcctctagtaagggtccatgtataatttctgaagtcagatgagtgccaattccaaagacctctgagacctctttgcagggttctcactctatcaaatccatccagagagcttagcagctccagagtaaaatgggataatcctaatcacaccgtgtgtccaggcaatccctggagtagggtaggcagttgcatgtgtgtctctgtgtctcccctctatgccagctgcagacatcaccaatgaattgggctactcttcgccgtggaccctggatgcagccagtaccaaccagtccaagcttacatgcacaggaggacactagttcaccgtctttgtttttgagtaactcaaattcttgtacatacctcagcttctttttggaaaatccaaatatgactttcctgtatgacaagatgctatagggcatttctcctttagcgaaccaaagaagtcttccctggctttctaaaggcgatcacttaacgtttactgccctcattccttttctatcgacaaaccttgtatttcagcacaaactgtaattctcctctccacagtaagttattggtgtctcgggaacttgacagacccagtcaacattaaaagtgctcctagattggtttttagctctgcttcttaacttgattccaatttggattacaccaagcctggaactctccatgatttattctcaaccagcaatcaaataaaacataaaaaaaaatacacatggcattcccaccctagttacacaaaaccccggcgtgaagcaggttcagcaagacttctttttttgtttgcttgggtttttttttttgagacagggtatgtctctgttgttcaggctggagtgcagtggcaggatcatagctcattgcagcctccacttcctgggctaaaaccatcctccccgctcagcctcccaggtagctgggaccacaggcatgcaccaccacaccaagctaacctttcaaaattttctgtaaagatgaattctccctatgctgcccaggctgccctgggctcaagtaatcctccagacttggcatcccatagtgctgggattacaggtgctagccactgcacctggcctcagcaaaacttctttggcaggaacctggtattgaatgaaatctgcccagcaatgaaaaactcttaaacctctgccagaaatcccagcagatcggtgcagtttgtcccccatcttgctcatctcccctgaattgggctgaagagggcttcaccaagcaaggaaatgcacaggcagtggcccaggcagccgagtacccacctccatgggctctcgtgtggggcagagggaagtgacccaaaggagattcattcctctggtcaccttcatgggtgctgcaatcctatgggaaatgtcctcctgagcacaccgtgggtgccccactgtgctttcattagagaagtgtgtgaaaacctaagaccagaaggtgagcttcaggaatgcaaaccttcaggccttgagagtccagggctgggaacaaaacactgggaccccaattctgcccatgggaacgggtgagaatgatgagtaatttacaaaaacaagggtgtgccagtgggtgctttgttttggggggcactggagcatcagaccagggagctagaaacgtctgaccaagagaggcttctgaaggttgaccagaaaaaagagagatggggggtctagtgtgagtgggctgctcacctggaggtgagaggctgtacctgctctctgaaggaaaagggctgagttcttcccaagagggcagatgtgtgtagccagttgacttgggtggaaaacttagtctttagcaacaatctgcaagttaaaccaagccaagccacatgtcctgcttagctctgtagtgaggccacacccagtatttatggcaatcttcatatttacataattatttatgtgtaaaatatatatctataaatacattacatatatttgtatatatagtttcctttatacccatacaaatatacatatgagcacatatatttacatataaatacatatgccccaataaaaaggcttaagtatatatttgagtatatatttgttcatatgcatgaatgtacgtacacattattacatgatagttaataagccatagtctttgcatttagatagttccaagtttgaatcccagttctgtcacttagggaaggtgtttccttgtgtagattatttaattgagccttaatttcctcttctgtaaggtagaaatagtgacacatataaattaccatacaaatgtaaggaataagataatgaatataaaatatacaaaataggtgatcaatggcagatacagctatttatgtaactagcacctctgtgaccacaaccagctgaagaatgagtgcctcattctcttgggttggtagaaatcagggtgggggctggtagcacttttatttaaggtgttttgaacaaattcgtctaatacgtaccatccaaagggctcataagaggtaccttttttcaaatcaaatgcttctattgcaagaatggctcatttctctttcataactgggtgattcagaggaggaattttctgtttgggtttataaaacacagtttctgggaggtaaatgtcaactccaaacaaaggagaacttcctaagaaagttgccccagaggtattgagctccctattacacaggatgcttcagcagaggcagggcaatcacatacgggaatccgaagtcagatgagggctgcactgcgtgttttctgaggtccccttgcaccttgaaacccacacattctgtggctttttagaaggcgccctctgagtgtgctgtgctgtggtttctgtactgcctgcccacctgcctcccaccccctcctggtggcctctattcatcagttacaaggccctgaaggaatccaatagtgaggaggtgagattacattctgaggaaatgggtaaactgaaatggggctgggattgtactcaagcgggcagccagcttcatttagcggcttgtgcaaagtcttattaggaaaatgcagccacccagaacagcgggtctgctcgtgcatggtgggaggggctggctggccacactgcaggtggaaggccttcccttcccacacttgtacagcctcctgccaggtcagtgtgacctgggttctgctccctcggggcatcaaagtagacgttctgatgcaattctgcccctgccaacaaggtctgctttctctgagcatccctccagaggaattttttgctttacctcactgtttccccaggcctttccagttttcttttcaccaatctaaaggtataaaaacatgtcgcagaggaccctgggaataggacgtggaatacactgagtactgggattcgaactggtatcagtgaagagaaattgggcaaatgacttttgatgtgcctttcaaacatccaggaagatgatatctgctgcccgagagggcaaggaatgaataagaataggtggcaacaacataagcagcagctgtaaagccttttcttcctaaaaagaatgactagagttcatcaaattcaaaccccgtgattagtggcctcgcgattttaaagagatgggtgtttgtgcaagtctcaaattatcaggccttcctctctctctctctctctcacacacacacactctctctctctctcttaaaatgtgacctttctgcaattcaaagaaccataagcctggaaggaaggacgtccagttccctggtttacagctgcttaagcctttgccatctgtgaaaaggtggagatattgagagatataactaggtatatttgtgactatggcaagttctaagatgcatgcttatgccattctaaaggaagccctggaaattttcagatgaaaaatgtcatagaagtttgagtttctgtaattatctatttatatgctctgggtgcccaacgaggggtcagagattgcctcatttgctggctatatagctgttcgtaagtaagtgtaatgtgacacacactctctattggctcgtagggatgggaaaatcagttaggtcacatctgaaagccactttacattcagaggtcataaaccgagaggaaaaataaccaaaagtttcagtattcaatttgtttactctgagcaaaatgcaatctcttaaactgatgatgagaggaggatgaatgagatggaaaaggcttttaggagctcactttaaaagctcaaaaggtgtctgggacattaaatagctgttaaaagctctagttggataatttaagtgtaaatgagtatgaactatatggattaaatttgccttaaaataccagtctgaaaaattatggaaagactatttgagacaaacaacagttcgcctttttttcaaaacctgaacattacgaaaaaataattttagagtttcagtgaaagctaaatgcaggcagatttaactgtccctagtgagcttcccattgaaagccacaattcagtaataattatacctacattaaaataagtacatgtgttgatacacacataccacataaagtgtacaaatttagcctaagcttttcaaagctttttctatcataaatgacgttagatagatatcgacaaaaattcagccaataaatctgaaaatgtgaatttaaaaaaaccttcataatctgaaataacagttcatttgatcctttgggggatttttttaatcttattattaaaattgggaatgttatgtctttatagtatattttacccaccaattattattattattttaagggaaaagtgtttcatcctttatttcaaggaaagattgtatattataaaaacaaatattgttatgccattgagtacagagctcacatcacaaacatttaaccattttcatcatacatctgatgatctaaaaatcaaaatcactttgaaaggcttaagtattctgctatttcttaaagatgatgttatcacattatagtgacacgctactgttttaaagactgaagtaaaaatgagacccagtaatttttaaccaaaagtgtatcatatcctatttacttattttataagatcaataaacatgatagtaagacttggcatttaaacattaaacatgtctaaaccccctgaagagtataccagaaataagcaagacatttagaatgctttagtacttccagttaacaccatttgtatcagcaactgcaatgttgtaacttttagcatctcatgtaactagtcagtaaggagttttttaagtgtaggagtgagaatacaaggacaggagctatgagaatgtcaaattttatacttctgttaaaaactctaaaatcaaaactgttattattaaagcccctccatttgctacattaatttctaaagagcattagtgtttttgtctgaggacagtcacacttgaaataatgctgctctaaaagaccaaatttttaactttagctgttacctatagagatgtctttctacattagatgttcattatgcaatgaggttatgtatgaaaaaggatcttttaaattattcattattgttattattattgctctattaaggtcatccttttgcttgactctaggacgttttctttagaatttaaacatgatgagcaacatttggcaaaaaaaaaaaaaaaaaaactcattatgaatatcatgtcctctctattgcccatgttttagaacattttctttcttaactcatcagggtgtgtgggttcaaaaataaaaggaacccagcttgagagatgagaaaattgaggcacagaaaagtccatggtgttgctctacatcatagcggcagctactggaggtgtctggctgcagaacaactttctacactttcaatttcccatgtttcattgtaatatagcactagaatttaaggtgtccagcccagtatcatcaacataattgtttggagcttttgaggtaccaccagacataaaagcttgatgtgtggtttaacggcatgacgcagatacaaacgtggaattttagagtatggaaacccatacaaagggtgcagtgtcatgagttcactcttacctctcaacagctagggggccaggttgggtcccaaggggtctgaaagctgctgggaaatcccttcattcattcaaacactattctaagcgaatggataatagacacagagccatataatcatggagcctctgttctagcagaggacagacaataacaacagtcacagtgagaaggtaaatcacagaggctgttagaagatgacaagggctttggacaagtgagaaagtaaaagagagtaagggagatcaagagtgcagcggggtgagcagagtaggttacaacttcaatagggtgccgagggtcggcgttctggaagatgagacaatggagcaaagacttgaggaaggtgaggggttgaccaggcatggggaaagagctttccaggaagtggaagcagggcatacgaaattcttgatgtatttgatgaacagcagagtagtcagtgtggctaggattcaggggcagtgggagagtggcaggagatgagatctgagaggaaatgggaagcagggcggtagatgatgcccagctgtgtaggctgtcacggactattaggaggactttgtgcacctatcggggtggtgggcaggaaaaattgcttttgttgttgtccttgctggtttggttgattgattggtcattatgatgttgtgattggtggtggtgtgggtactttcatgctcaggttccagcaggtgaaggatcctgaccccccacctcactatgcaggtgtaaccccacccctttaaaggctctgcttagagtgatggagattgtaaaagtgacagctggcacggtcaatctgctatcaggctgtatgcactaggcttgccatctgacagcccagcgttcatggctttgtttgagtatatacactaacttatggtatttgtactgcaggtcttagaagcagacagtcttggcttcaactttgcattctttaactccctatcttgaagagtttgagtcaaatgcttatactcttgaaggtttaactgtctactttattaggattgttgtaagacttaaaaaaattgtgaaaagcgtgttgtgataatggtgatggtataataaatgatgatgctcacgatgatttagtccacacagtctgtgttgccacaaagccagatgactccctggccccagatgcctcatggtacaagatatacaattccagctattagggaagggcctctgggtacctcagctcccttctaggaaaccatgttccactgttgatgccaaagcatagttacagaaccttcggaagtgttcaagttttcaaagcccctcctctgacttatatgcaacagtgtctgaggaggggtatctccaaggactcaaggctgctgattgacaatgtcttattgtagtgcaggaaacccatccctgacaggtgcaaggctctgaagccttattgttcccagtttgagagggagaggattcagaacttcccagggttcaataactgaggtaatcaatagactattatgcttaaagagtggatttttaggtgctgggtgctgtggtctcaattagaggctctaaaaataacaaatgtccaccacctcactcactgggacccaggaaaccatcaccagaaagcagaacctgagggaaatgagtacattaaatcatcagaatttgcagaaatatttgattccttctggcaggctcatcaatcacgaatgattagaaagctgagttgcagtgggcaagcctctgttttgaatgatgcctcatttcatttctattactaggtggttatagtttgtagagagacttctctgcacatttttttaatttttgtttttcagctaaatcctttcctcttacgggagtaaagggattatggcaatgttcaaaaatctgagacagataaatgctcctagagggcaccaataagtgtcaagagacccaaaacattctaaccgcacacacctctgtaccaggcactacatttaatcttctgtagtctcaaaaaaggagcaagttcagagaagttaaaaaaatgtccggagatcatacctaagtggaatttgagacctggtctttctgagttagggtccaggttcatttcccctagaaaagagcttcattccaccttcacatttaccccaaaagaaaaaaaaatagccatgtatgttggaacctttagctcctctaaagccattttgtggtcatttcaactttgatggaacaggggatgaggaagggaacaaagaaaaaatgtccctttgagctcagtttccatagctttccactcaaaaaggaaagaggttcagtcaaagaaatacatgatacatataagtttttgtaacaaaaaccttgaagggaacttcatcagagaaagaacccagaccagaaaaagggatctgaattctgcagtggggcaacctgggaagagggagagagaagggaggggctggcgggagaaagaggggatagtgcaggggagcaggcaaaaaccacatcattttctttattatcatgtccatttgccttcatttttctgatgttctgtccatccgctgttaacacctaattctctaaaaaaataaacacaacttgagcaaattcagtgaaaaggctttggagagcccaattactgtgtatcccccagacgcttggaaatggacttcatttttctgtaatgaaaaaatagtgagtgacagcccagccaaatgaggcacgtcccagttccagcttcgtctgtcaggcacatgccgtgagagagactttatgcattgtcgcggtagcacgtacggagaggtgtgtgcgtgcaaatatgcatacttaaattaaattggaaggcacctacctgctcctgggtgagctgccatttttttcttcccaactcatcacaacagttgcttcctcctgaatatctagcaggtttctgagaaaagtcatgttcattatggaagttatttattaataataaatagaggtgaaactcagttagaaacagatacattatgttttctcatacctgatgcaagggcattaatggatgaatgagttctgccttacagtctgggctcatttctttagttgcctttttagatatctctagtttattcattcattcatccacccatgtattcatttgttcaacacaccattcatagaagtctactcgtagctgtgcactgtgttaggagccgggtggttaccaagctgagtaagcaacgttcctctatcagaattctgatctggttgggaaagcagacatatccaaagtcaaatatctgaaatatcaagtgttttatattctattagcaccttccctctgaagaatgataggttgtctcgcaaactcaaatgggtagtatttgccccatgggtttctttggatgggtgtgccatatctacacacttgcatttctattttcgaacttaattttgtggcattaagacagctgagaagtgtgccttttcttatgtgtgatgtgaaacccttgttctcaaacctctcaatactgaaaacttgtctggttctataatcttccattcagcaaatcattgttgaacatcttttccacgccaggtattgcactagatgcggaaattctaggggtaaacatgtctcacacagtccttgtccttatatagtttttaatctgtcaagggaaatagacatcaaacaaataattacaccaataattatttaatcacagctgtaattaagcgatataatggcacatggcagaatgctttaagagtgttaaatgaggtcctgacagtttgggggaagagggaggattccagaaaggcattcatgatgagtgaaatttacaataggaattggtcatgtgaagagaatgtaggacagcatttcaggtaatttttttattattgttgtttccatgtaagtatgtcttctcccaagagtgggttggtttggttcttagacaccagaggaggttgttaaagtaggggtgctttgggagcagttagaataggtagtcatggaatagcgtgatttatagggaatgaagtcttatatcttcactccagcacttggtgtatccctttggtcctagagaagggccattgctttagataacgtgtgcttcagtcttacagcagcctttattcacttggatggctagtgcttagaaattccttcagtaaatggacatgagaaggtgcatgaagcttaacagcagacaaaggataactcgaggtgagatgcatgtcaaatatgtgtcaaaatccagcttttcctgcttcaacttcactaatacacatatgtggatagccagcattggaattatatttacgatgccctactgacatacttcattgcactttattatccaaatctattcatgcaaaaattgagagatcaagagaaatttaatgatttactctgcaccacatcctgcgcccagagtaaactccagagagttataaaatcctaacctatggccctttctaccatgccccagctgcccctcgacaatgatactgaatgtagtagaacacacggtagtgtaggcttctgtcccgcattcattcactcactggtatttatacgtggtaatacaacaatacagtgcaatgcaatgtaatacaatgtgctaagcaataagctaaatgcttgagataaatggtgagcaagatagacagtctgccttccccagcataatgtataatacagtaaggaagaccaacagctaaataagctattacaataaatcatggtagatgctctgaagagagaaaaaaataatgctatgggagctcagagtaaggagctcttaaccttgcctagggtggttaaatgcagtttgagttcttaattacaaagcgtagaggtgctaagtagatgggtaaaggagggaaaaatatttttcaggcaaaaacacagcatgaatgaagaccctgcggcgaagtaaaacagagcgtgttacagggtccaaaaagtccacagtagagtgtgaggagaactacggcaggaaggaaagatgccacagggatgtctggtcctctcatattgcaagataatcatagtgacggcaatgtatctagaagcctgggctgccaaatagcatttgacaatctgccttcttcctcagtcggcattgccatctgagtctggatagtacatgacagacttatggcaccagtggcaatctcagatatcgatttctttaaatgaatacatgattagaatcagaatttgaggaatctcagaagtcatctagttctgctaaccctagcccaaccgccgccgtttcacagatggaaaaagtgaggcttagtgacagagcgaattgtccagagatctccgcagagctacaggcagatctgaaattagaatcacggtatgacagtttaaaccctttaaactggatcatcattatcaccattcattagttggagaaacatctgaaaactctgatattcaattgttaccctcctgacttaaagcctgttaacctgctcagtatcaaagacaccatttagacggagatgttctcttttttgtttgtttgttttttgtttttgagatggagtctcactctgtcgcccaggctggagggcagtggcttgatctcggctcactacaagctccgcctcctgggttcacgccattctcctgcctcagcctcccgagtagctgggacaacaggtgcccgccaccacacctggttaattttttgtattttttttttttttttttttttagtagagggtttcaccgtgttagccaggatggtctcgatctcctgacctcgagatccgcccgcctcggcctcccaaagtgctgggattacaggcgtgagccaccgcgcccggctcttagaaggagattttctatggcgttcctctgagagatcacgtgagtgcatttcaggagcaacatctggattacgtgatccgggcctcgcttctcagtcattggtgatcccaggctccctccacctacccgtcctaagacatgaataggtcaccgtagctgtgtggacatcgtgagagtgtggagggtaagcgtgggtgctgcatccattcacaaacctgcggaccagaagactccgccgaggcagtgcatttcttgtttccattttagaccagtgggtcacagctggtaaacaagcacaccaggatacacagatagaagcttcatcgagcaggagagcacagcctttgctcggccctagtgatctctcagggtgacattgggtgcttggtttttggaacagcctataaacagctttccaaatctactacccttcatttattagtggcttagatatgcaaatgtttctgagagtacagggtgtttctcttcctctcttaacacgctttcacaactttaacggaagaatcatagaatccagcagttcaagagctgaaagggcctttgatcatatagtttttatatttcatagctcaggaaactgaggactccagaagttatgcagtttcctaaatgtttcattgctacgtggtagtagatacagaactgaactcatcaatgtctctaagaaagagaaacaggaacagacctcagtatggcgagttctgctcactgtctttaatcacgctgatcttaatgtactgctgatctttaatgtactgctcgcattcattgagcattgatgacgttttaggcaccatgggaagcagttttttgtgcattgtctttttgaaaccttgaaacagccttataaaatatagccaatatcatcaccctgatttacagaataatacagttattattaaatgttaactgtaggcactagacatggtactacatcatgtatgtacattagctcttgtattcctcacggcagtagtagcatctccatctcacccatcagggagctggggctaagtggatatacataacttgtgcaagattacagagctgtctgggatttggagacagattgtgaaccctggcccccactttgccattgcactctgacatcttaggaagacctgaccctggcttgttggaatccaaaactcttgctcattcacaccgcgctttactcttcctaattttataagcacaaaatatctttacaccaagtggcattttcttgggattcttactcatccaggataattcttaaagacaaggaaaaaaaatactaaatgtttttcctactctcttgtctcacgcaacgcaacacttctgacatcagatgagtgagaaatttttccccacacaccaactgagcaatgatcgtgaggactgggcgttctccaattcaattcaattctgacactgtctacctggagacggcgtcagtccccatagggtgaggctcagcccacagcactgcctcccacttcaggtgctaggtgcaagccctgggttgggaccagtgctgctgatcagcgttcccagcccccacctcttcaggtttaattcatttactagagtggatcacagaactcagggaaacactttacatacacttgcctgtgtatcaatagaggatacaggggagcagccggctggaagaggtgtgtggggcaaggcagcggggaggggtgtagagcttccaggccctcttccagagcaccaccctcaaggaacctaccagtgttcagcaaccagaagctcttcaaaccctgccttttgggttttttatcaaagcttcattaggttgccataattgattacatcattagccattggtgagcaactcaaccttcacctcatctcccctcccaggaagaagagggtgggacagaaagttccaattatttaatcacagaattggcttccctggcagccagccaccatcctgaggccatcctgggccccagctgccaggcatctcattagcctgcaagaagacactatcagtttggagattccaagggttttcagagcagtgttccaagaaagaggacaaagaccatatctaaatgtgtatgtatatatatatatatatatatatatatatatatatatatatacacatatatatatatataatagatcacaataatacaaaaagtaatattttcttatcctgaactcatttaaggtcagtatcaactgataaactgattttccttgtttctgagaaataacagctacagtaaagccagcgttctctcctgtccctagcctgttactcaccagccctttagaaaactaagattgcttttgctctttagggggtgtttgtaattctgaaggatcatgaaactaattgtcagtttaggaatatcaacacgaaatacccaaacacacaaaacccaagaaactcactgtttgcatagttctgttgtgggtttgtgtgtgttcacaggtgcctagtgaagttaggccacagggacctgacaaagtgtccactccttggtagccttatattctcactggtgcccagatatcataacatccttctttatgaagacctgatggatgccacgtgatccagttcttcctcactaacttcttcttctctatcagagaatggagaataagggtaggtttaagagtcagggaggaactacccactcatgtgaatgacgaaatagaaatttcaaatgtgggcttacaaacgatttacatgtaattcaaatgaccagtttattggttttcttttaatttgacattcagataacaataaacttggcttaattatttcttgttcttttattttcagaatatgtattttgcataacttaaatacttcctaattgaagatgtcaattatcagttaagacaaaaaaggtcccttgtcctttgcattttttttttttttttttttttttttttttgagacagagtctcgctctgtccccccaggctggaatgcagtggcgggatctcggctcaatgcaagctccgcctcccaggttcatgccattctcctgcctcagcctcctgagtagctgggaccacaggtgcccaccaccatgcctggctaattttctgtatttttagtagagatggggtttcaccgtgttagccaggatggtctccatctcctgacctcgtgatccacccgcctcagcctcccaaagtactgggattacaggagtaagccacggcacccggccgtcctttgcatctgtttaaattattctgcaatgaatagaaattatataatttaaaagtcttagcataatctgacagctagatacaggtatacctcattaccatggacttcaccaatccaaaattttataatcattcacagacaggattgaccagatattgcgaatgacttacccttcttagtaatttatcttctagttctacctctttatacagataactcacaactccctattggcggtaatttgagatagaaaagtcctgtgtcaaaagcctccgaggcgaacactgacttccacctcctcacttagcctcctgatctcccatggcttcacctgagaggcgaagatactcctggcctcataccatactgtgaggcaaggttgagagaggaaacagcagcaaaaggaactcacattcaactcccccttcttagtaaaataagtttagaatctgtagagaatctactctaggtctctgcatttgtcccttgaggggctgccaggcagctgttattatcccggtttcagatgagcaaacctatcccaaagagattgagtaacttgcttggaaggtgtataactgaaagcgtgagatttggagataaacctagttttgagtagtaattctaccaccagttaccacgggctttgttatttatcatctcgggcaagttacttatcatctctctgaacctcagtctctgtgtttgtgtgatggtgacataacagcacctcctatgtaacagcagaaactgctagtcttcctgtggtaaaacgccagctcattcaggtcacgtgctcggccctgacacacagaagatactaaacaagtgcagctacttttaattatgggtcaggatcacactgctggtaagcagaagcgctgagctgcatgtccgggagggaggcttcaaagcctatgtattctcatggccacctgctgccttctacagaagcacacccagagatgtctgtgagatgaagcagcatgttgggtcctggcaggatcccttggctggtgtggcagagccagtgtcagtgatgcctgtttcccacctgagcttccacaaggaatattggggcctaacttgcagggtaactgagtgggttgctactagaagaagtttccctggaagaaacattaccttgaaatcatcgaaaacaagggacagagccgctggccaacagctcctaatctcaggtacttgggcaaaatgagggagggcgagactgttctgcctttgtctgctgtggagtggtctactggggtctttctgtgttgggaagggatatatgacggttgaatagtgaggtccccctgacagcagtaacagcacaccatcaatgattgttatttgtggagggaccatagaagccatgagtccagttccttgttttacaaaggttgaaagcaagacacaggttgtaggaataatcgccccagctgatctagctaattggtggcagagggaaaatgatggaggatgggttcggcggacaggtaggactggccatctcccatctacccaacctagtgcaggagggaaggatggcttcagccggaggtggaatggctgacctcctctgggcatgcagacctctgggcaacgttacctcggcagagacccctccttgattattccacctaaatcattcccggatctttgtctatttctttatgtctatcttttcacagcagttctcaatggctgacagtgaattattttttatgtgtgttcattgtctgcctgttccgctggaatataagctccattaaggcttggaggctttgtttggtgacagctaatttctcagcacgttgaacaataccagattcatagtaattaataaacaataaaaaaccattgattgaatgaatggatggcatgaaatactgacctaaaaagttaggaggtaaatactggcagataagtttggagaggcggtgagaaggcaggcagagacctccaaccctatttctcagacatagtggctttagccagtgttgacattttctgagctggagacacagcatgagaacaaagtcctccaagttactcattttctgctattctgctacctcaactctctggaattccagaaaatcccatctttttctcctctccttcatttactttttcttctttgccttttctgcactctgcttggatacagaaatgctcatcttctgaacaacgcatcttcctggtgtcagcctcttgctctcatgccacttacctacttacttatgataaactgggatgagatatggctccccaatttatctcaggaaaagcttagagcaatgggggagaaaaattcatcaaaacgtttgaccatcttgatttgtaggtaggacctagtcatttattgggtgtcaagaattgtgctaaatcttagaaatgtagactaaaaggcataaaatatacttccatgctatggaatccaattcaatggtaaaaaaaaaaaaagcatgcattgttttctttccaacttttaatttccaggagtacgtgtgcaggtttgttacgtggctaaattgtgtgtcctgggagtttggcgcagagataattttgtcacctgggtaatcagcataatacctgataggtagtttttcagtctttaccctccttccaccttccactctcaagtgggcccctgtatctattattcttttctttgtatacatatgtactcaatgtttatctcctacttataagtgagaatatgcagtgctcggatttctgttcctgcattaatttgcttgggataatggcctccagctaaacccatgtttctgcaaacgacataatttcatcctttttatggctttgtagtattccatagtgtgtatgtaccacattttctttatccagtccaccgttgatggccttctaggtggattccatgtctttgctattgtgaatagtgctacaatgaacatatgggtgtatatgtctttatggtagaacaatttatattcctttggctatgtacccaacaaagggattactgggttgaatggtagttttatttttaattcttctacatataatgacatgggaaatattggaacatattgttacgtggaaaaaataagttgtaatttggcaaacatacattagtaacttgttttaaaaatatcagtgtatctatacctatatctgtatgtctatgtcctagtatatatctatatctataggttagatatacatccagagatgtttgagagattgcacgtacagaaaaccacctctaaaagcacaccacaattgtatacaagtggccacctctaaaagaatgagattgctgagggtggagattttgctttatgtactttggcatgtttccaatctttttatgtgaagagaaaaatatttgcaatttaaaaatcagagggaaaaacaatgacaaaaaaagtataaaatgagtatcttctcttctgcccccaaataaaccactctcctcttactaagggagacaggtgcatataaatgtagaaatcagtgtgccaatctctgcccacgtgacatgcacaggacggtgtgacactccaaggagagaggtcttgtttgcagcagtcaggggcgacatctcagggaaaaagttctcaagttggttcttgaagagtaagtaaagagttcagcagagacatcaggctttccatggagataggagctgtgtaggggtgggggaaatggtgctcatttgagcaatgcagaactatttggctggatggagggcgggacgtgtgcaggacagtctcgtgaaggctggatccagactgtgaaagacttctcttcaggagtctctcccgagtcagtgcaaagattgagtttgtttattccttcatttcataaacatatttgagcatctactggctgttagagttttactaagtatgaggatttaatgataaataagaaacagaaatcttgccttcttggagactctactttagtagacttggataattttcctttctttccaaaaaagacaagcaatggtaaactgcagtatgaggtgttggtagttagcattaattaaggattagaggcctttaggggaaatcaagttgttgctgaaggattagtcatcacatctataattcagagcagcatggatattccacattttgcggaatacttgggaaggatgaaaatgtacaagtggaaccaagacttcttaacatcaacctcagaatagctgtgcactcccctcccctcagtccttttgcaagatagagggttgacttgtttagctcatctatccagctaactgttcccctgcctctctgtcactggatttccatcactaggcgactgtagcgtcatatgtgtatgttgaagcactgaactgtgaatcttatcacaagaaaaaaatttcttaaaactaaaaaacaaaaaataatttattacttataagacaataataaaagcaaaggtaatttccaagagcaacatataacaatatattcttctgtttgttttcccccagagctaattttaagcaagaaactattgtaagatcctctaaagaactccacctacaattccctcttgccaccctctccccacctcctgcataggtggttctgattcttttcctgagttttttctacccctcaagacctaggtttgcccaaaatgtctgtgtgaactagagccccccgttgtttacagttagccagcttaacacttctcctttttttatatgcattattttgttgctgggaaagtaatccttctcttctcttatccatcatgttgtttgtgtttcttggtgtacaggagagtaagctatttatttaagtgctttgagttatgtaccttcccaaataaactattttaagatacagagatggatttagggattcatatactatctgtattagaagaaaacttgcagctcattggttcatatgcacccaatccagaatacacatcttctacgcctccacagcatgcattcaagcagcctctgccaggccctccctaagggcctaagcatgtctgctacctgacacagctcctgttgctcccagtagctgtggctatggaaatgggcctcatcccatcacactcccatggtctctctgtaaaatccacatgctagtactagtcctgccctgggagacaacagaatagatgtgagtccacctctccacagtgcttcacgtgttcccatgctgccctcttgtctcccctgacaacgcctttcttcatgtccatctagttcccaatcgtgaagttcttctcatttccggctctttcatgcccaatgtcttggtttgtacagtctcctattacatgttgtcaccagatatgggctccctagagcagagcagagccattttgtctcttttgttctgattctttacttgctaaatgtacctactgtggaaacaaaatgcaatgtatgatcgaatgtccttttgttaaacagccatttcactttttaaaactcagaactgtgagaaaactacaaaactcctgaagatttttcacacgtcttgctatgaaaacacatctccccactgcgggttattgtacaggaccagcaatcataattgaatagagttttaaacagctgcatcatatccatcaatataaaaatcgttgaatgagatagaaatcctttgaacccattttggaaggatatccatgtgagtttttgtttattctaggaaggttgaaaaatatcatttcatttattttctgctagcgtagaagtgtggaccttacacaggggaaggagtaccttgaaaataggtcgtctgtctgggttgataggttttgtgagtaggcctggcggttgtgcagtgaagcctcctggaggaaggcattttagtgtctgccatgtgccttcttttcaggctatgaacgtcccagatatatgcctgttttctccctttttcacccgttctttgactaaaggctgtttggggaggcgtcctactcggatcacgcttgttccattgaagcaaggcatcagtaaagttgatcacacacaagcacttgtgaaagagatggtgactcagacttgctggatctcaagctcttgctagttcaataccagctgcatcaatgtagctattgactcggaattcattggcataaacaccatttgtcagccttccagagagaagagttccatgaccaacctaaagactggctcactcctgtgattagtcattcccatctaattgagcaagtggcttattatctaggcatttccagaccttagtcacccatgagaagcagtgagatgtggtaatgagtccacactagcaggcttagcattatggcagctctcctattgtcacgtttattaggcaggcaccatgtgctgagtttggtagaggactttgaaatgaaaaggtagctgcctttaatgagtgaacatattaaggtttaatgatctcttaccaaagaattgatcctttcttagataaaggacaatgtatcattctacaagtaaagcaacaatttaatagtttcacctcgccaaggctttcagattacatagaatgagattccaaggatccattatacctgatggtatcactcagggtgccggtaaggaagagagattgtgtagtggagaaaaattgtttgcctgctaaaatgccatattgtataaaatattttataggtgtttcaatagattctatcttccactgggggagaaacttaatttaactaagacagcacatttctgagagtgtactgatttgaagtaaaacaacacactccaggcaattcactcccagttggattggcttccttggttttgcggtctctgcaccctgtctttactagaaaaggcaagatgccctctctttgagtaatgtcaaattgtacacagaattgcgcctgcttccagtaagccattggggtcactgcagttacaggaacaggtccttatgcctcagacatgtaaataaatagctctttagtatttcagaggcttatcaattatgagtgcccaaccacagtgcaactgggcaattgactatgcatcttggctcgcagattagtctttctttgacttgctgtagctgtgggatggtctcaattgtccctcaccctcctcacaaacattgcccttttcttccattactctatgctggctttgcataagaaagaagaaataatatttgactgtcaataaatctctcagtgagcagtgctattaaggggcaaagtatttttacatttcagagttggtgcttaggtcaccaacctatcccctctggtatcaagcagtctacctggcaagagagttagaaaatagccttcaccaaggggcttagattttgtcttctcacttttgaaaagatgaatatgtatgagcatctctccagagcctctgaaaggatcgctgggtggagggtggaaacccagtcactgaagtccccatggagaaaagataaagagttggactgaacagctgcttgaatggatgcattaaactgacattaaaatcaccaacgtgtttgagaaatccactaataacacctagcaaggctcaggggcagaatcgatttagggagtccaggaaattccacacctggtttggtgcagtaaaccccaaagtcattaagaagaattagttaagcccccttgttcctcctacatttattttcactgatcctatttagttccttcttcaatttgctaagacacaggtgtatactgatctcagcagctcgtgaatattttaaaactaaagtttcttgcaaaggaatttaacaaacaaaagtctcaactcactaccttaaatttatattctctgagcccttaagctcaaggaagcatttggaattgctttgacttagagaaaaggtagaaatattgtagtctatgagtgcgctacctttcaagaccattgttggtttagtatggcaatatatatcattcatgtgacagatattcattgagcatatactatgtgttaagactctgcttggtgagggagaatatagctatgaagaagacaaatgtgtccctagtccttatagagcttataatcttatgggaagatgaaggtacataagaggcataagcaggcaattttaaaatgtagaagtaaatgtgacttttgaagacaaagaccacttccatgataacttttaatcctatacttcttcccatgctaattgaatcctacacagataccatggagatgttttatgaactgtgtgattgatggcagaacatattcattaattttgtccatggcacttgattgggtgtcataatgaatgcggaaatagaatccaaaggaactttaatatattgaagaaatgtttttcaaagtcagaatgaggttccgcaaggacaagctggggttttgcagaaaggcacacatacatgtgcaggattccagcatcttttctcacgggtgctgtttttacttaagcaatggcctccaatgagcatttattgaaccgctgctacctgccatgcacaatacaggaggagacttctatggattagaataatggtggtcaatgctagggtgatgctgaatatggaaacagtcagagttttactaaaggccaaagagtattaaatttgaagttactagcattttcccccatgagtatcctcctccctgtagcaatggaattcaataagtatatattaagcacctactacatgcaaaactcatgcactctggaatccgacaacttactaggagaaaattgcacagatttaattttgtaccagaaagaagtaaatcaatgttataaaagtggaacagttaataattctactggagtagaaaggaaacagggattgatactaatcatgaaaggctacgtgaaggagttgacatccgagctgcaccttaagtgtctcagcatgtaaagcagtgaattccatgctggaagccagctgaacaaaaccacagacacaagcaagtggggagagattcaggggcattacgtatgtgtccctggagcaaggttctgaagggaaaatgtggggatgaagctgaaaaggtaaggtgggactaggtcattagcatagattttgaatttcattctataggcaatacgaaattttcaaaggatcttgaggaagaggcttttgtgttttataaacttgctatatgggcaaagtgaaggacgtatcggagatggaaagggcttggtatcagggggtagttgtgaggttattataactcattctaacttcattatcctgagaagatgtggcctgaagtaaagtgatagtgataaatgtagaaaactgaagcagccgggcgcagtggctcatgcctgtaatcccagcactttgggaggccaaggtgggcagatcacatggggtcaggaattcgagaccagtcagaccaacatggagaaaccccatatcttctaaaaatacaaaattagctgggtgtgttggtgcatgcttgtaatcccagctactcaggaggctgaggcaggagaattgcttgagcctgggaggcggaggttgcagtgagccgagattgcacctattgcactccagcctgggcaaccagagtgaaactccatctcaaaaaaaaaaaaaaaaaaaaagtgggggaaggggaaagggaagggaagggaaggaatggccatcggcttcaatgagtggagggagtcaggtttggacagacttagacagttacatcaaggtatattagcttctcccctaacctcaactaggcaacattctttctcaaaaaatgaacaaaatgtggacatttatatctaggacagagcctgttgctgaatccagtaacttaaaagtatcatgcttttgaaaacttcctctttttctaaagtaatagcttgtattgttctaagtgttgttttctttttctttctgttttcattatggggcatataggacattgattattgctgttattattgtaattcttaaaattacattttctttgaatcataaatcaatgcattatctcccctcaaggacttcttctatttaaagagccagatcgatttttacaggatatgccgaccataaatctttggttcttattttttcctcctgaagactttggatcagaattattattatcattatttattatttattgagtgctgtcagtgggctcagcagtatacaaatataaatgggtaaacatcatcattaaatctgtttccaaaaggagcaggtgtttatcatgaaagaaagtatttgaattaccaaaatagtgcccattagtggttttcatttcctggaaaatattgtctttgtggtcattcaactcctgtggcatttcgaatggaataaatgggggcaatctctcatttctggcttgtttccaagttgggaattacctcctacttcttgaaagttacccataatttaatttcagtagctttggcttgataccttctaagattttctcttcattagtgacttaaacaaagcccagctcagttctttgcgggagatgcttttactcactccttggatttctcctcttggccaactaaaaagaagccagcccacctaggatctgacttttttttatgttattcagaaatggagggattgtaaccaggaatgtacagatccaggattcttctggttccactatctgactggaaagaggcaggctctctcatgcacagtttagaggcatgctgaggctccttgatcttgccaccaccagaaggaccactatcaacaaaagcactcaattctggttttttttggtcagggaggcaaagtctttgtacccatggttattttccagcaaacacttctatggtctatgttagcagagaagaaacctacagccaaaaaatctgccatttatctcgaacctttattttagtaatttgttttaacctcaattcaaatgccatgttaacaaaactggaaatgaaaaaaaaaaaaaagaaaagaaaagaaaacacgaagcaactaatgctgttgattggaggttaccagataattatagcaaccacaactaaaatttgttttgaatttagccttttgcacagtgctttcccttatagaaattgatattcacaacagtcctgaacaggagggaggaagtgtgttatatttagcatcccaaatgtatgaaagaggaaacagactcaaggaggctaagtgacttgcccgcaattaaacagccaatatgttgcagaaattgaagctctgtccctttctactacttataattgaataacgtcaaggaagagacaaagaataggcaaccagcggtggaaacaaaggaaatgcaagttttaccttcagaaagggagtggtaactgcaagggtaatagaattgctgaacaaataacttttaagcctccttctggatctatgagtaggcaattggtcggacaatcacatagaacttagatctgtttctcttccagacctggatagaaaccatctcatgtatatattatgacctacactgggaaatagacccatttgtagatagggctatcaatctgcagatgagcttcctccctgtccaaatttggaaaaacattcagggccatcaagatattagtattattgactctggcttcagaagatcaaaaactctctgaccaagaaggaaataattctgccccttcatctgctttgctaaacgaacaaagacaagcacttacaattcaatgccccacaaaggccttctgtgcatttattcctgcaaccaacatttattgagcatttaccctgcacaatgaagtctcattgttctttttttactgtacctatctagaaagaatctatcttcaaacttgtctcagaactaaaaacagcagacagttcaagtgtttctatttagctctaaggttttctatattttgggttagagacaagcagaccattcaccaaaagccttgcccatttaaaaatatgaccaatgactgtacatgggttccaacatgcaacacacaaatggaagttttaatgggcatctgtgagattgctggagataagaaaaggatacaggccaggcatgggggctcacacctgtaatcccagcactttgggaggccaaggtgtgtggatcacctgaggtcaggagctcaagaccagcctggccaacatggtgaaaccccttctctactaaaaatacgaaaataagccggacatggtggtgggtgcctgtaatcccagctactgaagaggcagaggcaggaggattgcttgaacccaagatcacgcctttgtactccagcctggatgacaagagtgaaactccgtcacacacacacacacacacacacacacacacacccacacacacagaaaagaaaaagatacagaaatactttcactcttaggtagaactatagaatttattttgttctaatgatttataatgtgttgaaatatacattgaacattctaaattaccctctacaatcattaacaaggaagcaacagggaaggaactcttgcattttataataaaatgacaaaccaattttttaagtgagcaaaaaatctgaatagacattcacttaaagaaaatacacagatagtcaataagcacctgaaaagatgcttgtcatcactgatcattagggaaataaataccaaagtcataatgagatatcactctcattcgccataataaaaaagacagataatagccagtattcatgaggatgtagagaaactggaaacctcgtatataggaaaatgaaaaaatggtacagccgttttcaaaaaaagtctgtcagttcctcaaaagtttgggtgtggttaccctaatattcagtaattccaccccgagacataaccagaagaaataaaaatgtatgtctacacaaaaactttcacataaatatttatagcaacattattcaaaatagtccaaaaaagaaacaaacatataccttattaaaagatacttgaataatggataagtagaatatagtcaagccatataatgaaataatattcggcaattaaaaaaaataaaacactaatacatgttacaacatggatgaaccttgaaaacattataccaagtgaaagaagctagtcgcaaaagaccatttcttgcataattttatttatacaaaaagtccagaatagtcatttgtttctagagagaaaagaaattatatgagtggttgtatagaactggggagatggggagattggaggtgactgctaaaggacacaggatttcttttctggggtgatgaaaatgttctaaaattgattgtagtaattgttgtacaactctgtgaacaaactaaaatcagttgaattgtatactttgaatgagtgaattgtatgttatatgaactatatctcaataaagatgtcaggaaagaaagaggaaagataggaagagaaagagagagggagggagggaaagagagcaacaggaattcatggtgatggtcattcaaagagattaccacaacatttttgataggcatcaattcccttctcccttcctctttttttgtcccttaaaatggctctggaaaaggctacaattatacttgcacatactgccttgcaagatggaaccaagcttgtacacagcttttccatcttttgtctccatggggaaattttagatgttggggactgatgatagcttacagcaaattcccagctggtcacagcatgtttggactctggatttcaggattggaattcatcaggcacatttgtgtgtgctactgtctgtaggattatatctttgttgatcctgcctgcctgtgaccaatgggaactatatggaagtggtaaagtcctttggaataaaaatttagaatctggtgaaaacgtaaccaggtcccgccagggaaggatgaagcatctgtgtggaatctgttcagtacaaggcagcaaccactccttattttccctgttcaattagaagagtgttcaattgccctagctgcaagcaacctccagggatagatgtgaagtaactgtgttttgtttgtttgttttgtttcaattactcagacaactggttcctttgggagtctaccttgaattgattggagccctacctggtgactgtcctctaatttatattaataagctggttgtgtgttatgtgataaagtggccagcagatacaatgatttaggagggagtttcatatagggaattatgaaacctggccacaacctctttgtagaccagatatctgatatgctaggatctcctgaaggactcttatttctaaacaagatgagagatggacaacctgacttctcagtattccagtatttataacaatggatactacatttatttatcaggtaagatttaactagtatccaatatacaatacttcctaattaagagtccacttttcagatccttgttaaaatatgagatgtattttgtaaagaatgttaggttccatagttgccagtaagtatgtaatctagagctttcttccttagtcttcaccttgcttctctaataaaagtggataaactgggacagatagcctttaaggtcaattacacactaatattcaaaatttatgtaatttaatggaaaatcatattttttatttctttatccaggttctgatttcatttatttatttagcaaatatatattgagggaagaagaaccaggacatagtgatggatgggaagtcaggggtgaggggaaagaaggcagtaaggatgaggtcttgatttgggcaagtggatggatggtgagaaccatttaaccagagagagaatggggaagatattttttgcccatttatttgaggagtggggagtggcaggggacaagggccaagggctctgttctgaatatacagagtttgtactgggatatctttgaaaatataagtggtgatatcacctggctagtagtaaatgcaaatccatcactaaaccagccttctgtgagtgtcaaagtgcagaactcaggcctggatgagaagtgtggggtgcagagagactgcattcagggtacatatactagctacgtgagatctacatgcgacagaacctcactagcaaggataatttatagatcttcatttgaaaattttggggaacataaactacctatagttaaaaatagaataacaaaagggaagattcccttttctcaactattatatttcttccccaaactctttgcatttaacaaatgttttcatacaaacacattttaaaacaataattttgtgggttttttctcctgcatctgtgactttttcttctcatggttcacttagaagacatctcaaacttttttttaattcaatcttctattttctatggaagaggaagtgaagattattttcccttttatttttcctttttgaattaacctgtaacaatgtggatcgcgatggagttgagaaagagaaggcagactttaatcgttttccccactcttcctcagagaagtatttagtaaataagaaaatgaatttatattgaacagtgaccacagaaagagccagtgataaagacagatgtgaagtgaagctttcccaaagatacagtccccctcctggaggtagcatgaggcccatatgattcttctagtgtttgacagcactcaggaactcaatgaagtcctaatgataattgcaatgacagcttttggcaaatggattcattctttgccattcacttaatcctgaccagaaataaaactatttgttaattgatgtcatttcctcttgagaacaaaatagtaagatttagaggtccgaagctaggtaacctagtttagagctttggcttggacagaaggcttcaaaacctgttttttgttgtcacccagagctgcctgagtgtttggacagcatcacgcaccaggagtgaaacgacttggaactgtgttctgactccaccatgtgttagctgtgtggtctgagacagtttatttcatccttctgatcttcagtttataagttgggaaaaatataaaaacatgtgacagttccatctgtacactgtacttcatgggaatattacaaagatccatgaaataaaggatatgatagctctttagaagttgtacacaatatatgcgtatgatacctaacactgggaaagagatactctttcaacattcctaagcacggtagctctagactgcattgcacagctgctgggtgccctcttgttgaggggacttcaagtcccagcctcttttaactgtttagtgcttttggcatatgccttatactcctgtcttggtgaagcagaaaggtagaagttgcgcaggggttggatctgaggagctaggccagaaaaaccaacagaccatgcgaaaagaagcaactgaataggtatccacatttggggtagagagcaagcaggtccagcatttgacagctacaacttttggtggaaaccatcaggcctgaaaccaatgcactgcagagtggatcatcccaaccagtagttctttacgcaattcctgccagagctggagctgatacccaagcagaggcaactttgaagagactacactgaaagtggaaagacgtgggatgtgtattataagtgagaatgtggaagcctgtggtaaatgtggctgtaggtgcagatcacatctgagcaccatgccacacctccatgactcccttgtatggattactgcagtcccttcctgatggtctccctgcttctacttttcttccctgcagtctattctcagtagagcatcctgtaaaatgtaaatcagatcatgtcacttttcagcttataatgctgcagtgattctcagtaaatgctcagatctaaacaggctgtggatcatctgaagaccttgtcctctacacacaccaccaccaccaccacgacgaatgcctctttgacctccctcctacgccaaccagactcaccctgttccaggcttctcaatgaggcctaccctgagaaccatccttagaattctaactccctccagcctcagttccctcaccctcctctgctggaaaactttgcccacactgagcaccagtcagcaggctgtgtacttggctttcttattatgctattgattagtgcttgcctgcaccttctaaaatagagtatataaatacaaggatctttgcatgttccattcgtggatgtaacccaaacctatggaacacctgtgcataatatacatgtcctaagtatctgttgaatggctgagtgcagaggccacaaaaatggaaggaacccaggagtgagctgagaatagcgaggaggtgagtggaaagcaaggcccttctcccttacccctctccattttccctactttctcttccccccgcccccgccttttttctactctctcatctctcctgtattctaatttgcccatctggtgtaagcatccacttcagaggccagcagaggcagctatgggcctgaatttgaatcgcttttcccagtaaggaggtcacagaagtgatatttataaatcaataagcatctcagactgacaaaaagtaaatgagttatgtgtccttaaaaatctgcagcctgggtagccaggttctttctttctattgtatccctgatgtgtaaaaacttctcttttggagcttacaggcatagcccacagcagattcttttgcatattgccctaggtaagagattcgccttccctcagagtgggactacttttgagaagcaattaaatgccattgaaagccaagtctcatgaacaaactaaatgatcaagctggataatatcgtttggatctgaaataactacaaaggatggaggctatatatttctggttttaaacctaaatttgctataaatgtccagaaacatggtcataccattgttggaataagtacatatggaataagtacagtgactacttggaaaattgtactcacatgtatcttctgagaatttaatgtaaagaaaaatcattataccatcatcatacctcatgcttttcacagaattcagatacctgtatttaagtttctacatctgtagaatgggagtcaagaatgttcttttcaagtcatggtgggaaaatgggagtgcaaggaaggataggcataaattgattgcagacccaccaaagaaaggcaccagatcaacgatgagcggttgttttttttgttctcaaataaaatatctatgggagccttagaaccaaaatatgccatttttcttgcttctcattccctaaccccatctattctctgcctctccctttctcactgaatgttcttagtagatttaaccttccagattattccctatgctcaagtgttctctaagttcttcaccctccgaaccccatctccatcactggaccattttgtccttcctatgagttgcattgtagacggctgtctaccttccctgcaatgggctgcagcctgcagcggctctcagtgaggccctgctgacacagtgaaataaagttagaaagctgtattaatttaagtggctgttcttcacatttaggactgctattatggtgttgatggttggtaataaaagaccttttagtgtgggaaatcaaataatcttatacaaacataaatgggctccgacaatgattatcctaatgtaattggagaatgaactctgattatgggtgtcagttcttgcctttcttaaggtattttagggctaatacagtgattgatagattgacactagctcttcataaagtgtggagtttatgaatatgttgcatttcttatatttggcttctctgtgccctacacttttgtgagtatgaggtttgaaagctgggttggctttgtagaagtttccagacattttctgcaatgaaatatggtagagtcaaaattgaaggaaaaaatcaagccagccatcgaacaaaaatctgtatggcaagatgtgctcatcaccactcaggttcccaagggaagtgcaagaaattacatttaggatgagactagaaaacgtcctgcgggaaacggttctctattcttcagggctatcattcacctgcctaggaaaagatttccatatatcctgtataatgctcttgcctgtgctaaataacatatgattaaaacatatttgttgaaatttaataactgcagtcaatatgtcttctgtgaatagctgccctatttggtaaccgagatctactgtcctactgaacggaagtagacttccccgtcttaattactctaagtagatagttaatttaatggacctgggttttatagatctgccaatggtgatttttatgagtagataacggagggccagcggagcacacttctaaggcacagatgtttctgccatgaccagcctcgctcctcaagccagcaggattttgctcgccttcttccctccccacggaaggtcctttctctctttcagccaccccttccccatcccatgccagcggtacctcattcataaccttcccatccttcaaggttgagagctcaaaggccacttcattgaagaagactaatcccacctccataaaaagtaaactcctcctcttctgcacgtgcacgttgtactgccttgtcctcagttacagcagttaccttttttcccacttggcataatattcaccaccctatctccccaaatacctagtggtgtcttattacagtgggcattccgtaagtgttaagcgagtgaggaaatagacaaatggatgaatctcagtaagcagtcacttgccactccaacctgaagcacctgccttttgaaccctcttgctgcaggattagggtcagcctctgagtccctacttcctccccttcaatgtcaagctcagatcatctctgctgagccagatagctacactgcgttttatcaaacatggtaatgggtgtgtgctgcgtaaataagtgggctttggaggaaaattggttaatctcccgtgtgagccagagtagactcgggtgtaattgaaaatcatggcatgtatttagagtacagatgagcaaaaagcattcggaagctatttcagggttacttttctctttagagtatgagtttccctcaggttcatgagctgaatagttcatgttggcactaaaccatactgtcttttacttgtattcatgtattttgaatgtttgtctagaatctccaaatacattttgagtaccttgaaggcaaaaactcaaccttgtaatcctttgtatctcttaaaataacatgaccatgatctcacatacaatacactctcgaaaatttaggtagcattttttcagtatagtagatccttaataaatgagtggaagaggaggtttgggaagaggttttttgaagggatggtacttatgtcacagtagttagaagaaaatattttccagtcatgagacagtcattcagtaatactagcaaagtcttatttctcagcttggaattctgccaccatcaggaatgttttcttcttcaggaaatcctacaggtttaggaactattttctgtggagtgaaaagttgtcctagccagtgagatgtaactttgcagagtgagatagaatttaagacctagcttgagatgaagggtttttctctgtctctgctttatccagcagaaatcgtgcagtcagtgtgcgtttcttatttacttttggcagaatccaaaaagattaagctaaaaacagattttattccttagagtgtcaggtctacctagaaatcccatgagattgggactcataaagtttccttttctgtaggtatttatagtcagagatgtggacccagagaaagctttattaatgagattttattcatattttaaagtaaaaacagcaccatatataacctccaccagctcacctcatgaggtggtgctaacaaaattatcacgttttcaatttccttgacacacttgagtcctcatcttggtggttttcaggttagaactacagattagccagatgaattggggttgggcgccttcgtggtgttccaggaagaatgactttgttctttgagagaacaggcatctatgacggttctcagcagccatcatatatatgcacatcctttcgcttcagcaccaccgcgttcctgggcactcacataacatgaagccttgcgaaactcatccccacctaaccaggaacatgctttcccatttcactttgttttccttgcaggtgaaccacctcttggcatctccgctctggctctctcagtttccaacaggtgacattgccactgttggcaaccctgggaggttcccagcacttggcattttttcctggacattaggataccccttttagagacaggatgaagtggcattcttctaagtggagcatccaggcggctgctttctttagcaccagaattgtctcttcctttttttcctgtcatgttatccttggagaacataactggcaggcagctggcaaggtgttagccttggtttggtattaataaaaaagaataagagatctgttcagcttagataaacacagaaattgcattgctgcatctcttctttgcattttataaaggttacaatgtttttctagcaccaaaataataagaaatcaatggaatggctaatcttttggtatcattttagcatgaatttcagctacaagagattagccatctctcagaaggttaacatcttgcaaaggaagacttcttttattcctgctacatggattttctttggtgaggcactgaagatgggcagtcagctgagggcagtacagttatttagcattaggggtagcatcacgttttgttttgaaaatctgaaggtgttaatcacctaaagggagaattcttccagaagaacaacagtgacacttcccaaggagcatgtatttgggaccttcttcattaagaaaatgtgtctcttttctgggccctgcttggccttgttgaaggcagattggaagagaagctgcaccgtgcaggcagatgttggaggaggcttcactgtgccagctttggaggagggactcagcatcggggctgccttccaattactctgtggagggatcagtactaggctgttgccttttgaagatggggctttgagagagtggccagtaaagggagtgtgaaacatgtccaatttatgcaaatcctcaccatacatgtgagcacatggattagtaatttgtctgatggcagcatttgccaatcatacttttttcctccagactgagggctcaaggggcattgatcagctctgagagggatcttagcacagtgtcagtagctgagatccagcctggacagaggtatttctgaggaggaaggaaggaaggatcaccctggagtttggttttgagaatatttgccctgtagaacaaaagtataatagatggagaaaggttcatattccccccactttgtaaatttttttttaaagttcactattctgagttaattgcagattcacaagtagttgaaaaaaatgatacagagaaatcctgtgtcccttttacccagtccacccccgccacccccgtgcagtaacatcttatcaaactctagtagaaaatcacaaccggaatattgacatgcatacaacccactggtcctaatcaggttcgcccggttttccttgtgcaccgctgtgtgtgtatttagtcctttgcagttttctcatgtgtaggttcctgagtttaacaccacaatgacccgtgtgttcacaaacacacccatcttccttctgctccggtccccaaacgctggcaaccactaacgtgttctccctttctataattttgttattttaaaagtgttacacaaatgaaattttgcagtatctaagtttgcagaattggatttttttaaaccacataatttatttgagatttagcttggttgttattcagccactcacctgttgaaggacacctggggtgtttcccgttttctggctcttatgaataaagttgctacataacacttgcatgcagatttttatgtgaacataaaacagttttaaatcctactttccctcatccccactttttttttttttttttgctttgctgagcactcgctgtctccacaatcttagctcatgggcagagagtacagacgtctttccagactgcgtgtgatgcgtaccgtaaagcagccttcacagccttaatgagggcgagcgatgtcatacctattctgcaggcagggaaagcaaggtaggacgctcatcctactcacagcccctcctcccaaccatgtgtcctcccttctagcctgaactccatctttctccggagacactcttcctctcatttcccttcttcaagttgaaaggtgcctacgctgtggagggagcagaggggatgtgattcttgtgcagatcctcttgcccctcttgcaggctgtttccatgaagcttacatttgctatgatttgaaccatattgacactgagcaggggtgagtggtgatgaaagggagggaggttctgggaggaagtgagagttcatccacttctgggcttttgcaatcagctgctgctgccacgtgtccacctgcacaacccagctgtgtttgtcccaccagagactgaggggcattttacccattcgtaatgcataggccaggtctgggcaggtctgaacgcacacgtgagggtccgctacggcaggaaggacaataccctggccccagctccctagttcatccaacttctcaccaagggtggtgctgtaaaggttaggggactgtgtgaaaggccatgcttcctacggttctttcacagccgtggagcagtgctcatcactcacaccctagtcttctggccttttttgattcttgctgtctttcttaagcagggtcagggaccatatttaaggcccatggttgccttctgcgggatcctagtggcctaaaacaaatgttctgttattccagggcttccatcacctgcgcccagcttcaccttccagctttaccttctgctcctactagctgtcccctccatggttacccactggccgctctcctcctgccaccaagcctcacagggttactgattgcatctcattctcacctactttttgggaggctgttcttctatttgaaatgctctttcctctgctcttcctagcaaccttaccttcgaggtgtagttccaacatcttgtttcctgacttggacttttgtgttccacacactctgctctcagtgtataggatatcagtggtcacagtccctctttgtgggtctacatctctgtggactctgagcttcttcagaatgggtcgtgctctcctttgacctctcagtatcctgtatttagcagccacctaatggaagtctgctgagtgaaggatggagaagaaagagagtgccgctctccctggcctcagggggccccgctccctatgttaaccagacccttcccctgtagagtggtgaggagtctcctcccgagaagtcccaggtgctgttcctgggcacctgctggagaaaacactttgtcccaccccacagggctcaattcactgcacctgcctatcccctgaaatgccaaccaacccctgagatgtctattatcctagactaggggcattccagggaagtgaatgggttattctaccatcttctcctttattaactagtgcattattttatttatattattttttaatttcctgatttctcttaacctcacatttgtatctttcaggtgcctatgtatttccaaagtactttaccaagccagtgccacatagacaaaaattagacattgcctccagttttcttctgttttggtgagggccagaggggtctctagcctgacagccagcaggacagtaaatgaaatgggtgcctagaggaaaatgggggagggggaatagccagtcatggagaaaagagcttttgcctacttaaaagaaattaaatcagagttcagagtctttcccctttagaggcagcgagtgaaaacaatcataaatccaaaatagaagaatttttctttgaaacatctgcatactgtatgtgtgtttctgtaagccctgcatgcttaaaatagtcttctcattttggaatttgagcaatcaactcaattatgtttattaaactcccccaaactatgaattaaagcatctatggaagcacctacctcggctgaatgcccttctcacttggtccttctctggcaccctggcctctccatgtctggctgctcgtttgcgtactcagattcatgctcaggacacacactgtcctggttgtgaaactgtcccacatagtggttgtctccattccaaaatgctgcttccttctgtcctttctctagctggatgagaagtatgtcttatttccccaacgagcccagaggcttctggtagatagaaaatgtgattctactctgtactttccacctggcaagagtctaatatatatacatatattcatatatatatatattcatatttgaaaagtgaccttccagatcgcagaaggtcccagaggctgggccaggccatgcagaagactgcgaaccatgtcccccagagtagggagcctgtggctggcaagctctgcaccattttcctatctgaggaacgcacacacagtggtactcacaccctctgacctttgcctgaaccatgagcagagaggccgtgcttccaaaaatcagtttctaacacctctttgtcatccaggctgtgattcccattttgggcctgaggcttgtcaggcccagtgatattgcatggcctttgtgtgttggtatcacatttatgaatgtaagagctcctgactttagagcactcatgaatctgctcatctattgtcagttgtccttggaaacgaataccacttgactgatcaaaacggatcctggaatatgtgtattgacaaaactatcataattctgccttaaaccttgggattgcctcctgccagctctcatttattcagtgtggttcaaaagaacagaggcctcttgaaagaggccagatggcccactgggtcagcctcctttcctctctttcttcctcatgaagtaaatgaaagtctgcagtaagtgatcttgaatgtttaatttgatgctttgatatcaaattttggagccatttcggtgagtgtgtggggccgattccatgagattccacatttgctcgagcagctagaaaaatctgtggaccttagtgtaccacccactgttactgcgatttcactggatgcttctgagaagtcttgccctttgagggaattgcaccatggggcagtccgggcagggtcgggtacagaactggagttgtattcacattttttattgccactccaactattagattctagagttcctttccctgggaaagctagggtctggtgcagtctttcctgtccatcaggaagcaggattttgatttgtttatttgttttctcattcatttcagtggatttagctcagcttaataaagttcaagtaacctgtccaaaatcataaattagcattagtggttcaagattactgatttcctcagggttctgccagaatttatagccctctccacttccttccttcaaatgatagaatcttaaaaagtccttcaaagtcatccagctttatttcccacttctttcagatctctgataggtctgcatctagcccctgcttggatcagacgctatcaacaggcacacagacacacgttgctgtgccctgagcccttcacagatgtgctctcaaatatgaataaatattaataaatgaatacacttcatttttacagaaccatcacacatacatggttgtggtgacacctggcccttggaccattgctctgaaggtgctgagcaacttggtgttgccagggtcccgctggcaggatgatggcacaggaggagctgagctggcactgaagacaagctgcatgcccaaggagtgtgtgaagacagcctcatggctgggccagggtcagggtgctacacagctctgctgaaagttggccaagttgttagccggacagctgcagagttcttgcaggcgatttatttttagaccacagcagagattgtgtggtcaattatgactgatttgctacgttaggcagttcttgcattgctataaagaaatacctgaggctgggtaatttataaagaaaagatgcttaattggctcacggttctgcaggctgtacaggaagcatggtgctggcatcagcttctggtgaggcctcaggaagcttataatcttagcagaaggtgaagtgggagcaagaggaaggggaggtgccacacacctttaaacaaccaggtcttaggagagcttctatctctaggacagcaccaagaggatggtgtaaaaccattcatgagaaatgcaccccatgattcaatcacctcctagcaggccccacctccaccaggcctcactcccagtaggccccacctccaacattgggaattacatttcaacataagatttgggggacaaatatccaaaccatattgcttgcctaatgctgttgaaaaatctcatgttgaaatagtgccacaaatgaaaaaaaaaaaaaaaggaaaatgaaggctactgcattgctctcttttcctgatgcagcctcattacctcatggagcattcaattccaggtttgcacagctttgagtttgcacagactatcttaaaaatgcttgcttacaccagcctaaaaccttgctctctttaaattccacccaagagtttgtgtttgtttctggaatagtaataaatacatgaaactcagtgtttacccagcctgggtgtacatggaattatgtggagatccattttaaagtatgaacttggaggccacacccacagaaattctgtttaataggggcccaggagatgtatattttcataaagcttcatgggtatcactcatgcatacccaggtctgaaaaaatactgctttcccataatccttcacttggtagctgaactcttctaggttagttgaacattttttcataaccacaggcacgacttttttttatggaataaagaactaggctcccaacatacaggtctcatccgttgcacattcttgcttgtgtttcactgaggttcacagcactcagctgcgaagggagatagaatttagactcccaagtgtatccatctgcatcgtgcatgctgacctcagtgggttcgtcatatctaatgcggatcatctagaaacactctaaatccagactctcaaaaaaaaaaaaaaaagtcagtgaattacagaattttcttttaaggctctttgtccttttctgtcctttcctttcaatttcaagtttcctaattaaatgtgtgaacagagaaactgtgttcttgatagatgtaacctgtcgtgggttgcagtccatcatggaaaacctagttctgttttttttttttttctatttttctcttccgttacacttgtagacctataccaaagtaagtaaggtataaacatctttaataacacgaataaataagcagtagaggagatgacttgtcaggctttgagagagctttctcaccaccagctctaaaatagaaggcactgttattactcatggctccagtggactcacagcagatgtgagtccttcctctcagccacatcctttctgattgttgcctcttccatctgaattgagctgtggtcttcttctgtctgcccacacagatggtgggcctctgaaatacaacatagtctcctttttaaatctgctcagactgatcctaaaacaccaagaaaatcttttattatgtgactgagtttgtggctaagttagctaaaattctacttccaagattaacaaggcgtgcaggggcataatcgtagcttactgtagcctcaacctcttaggctcaagtgatcctcccatctcacttcccaagtagctggaactataggtgtgcaacaccatgtacagttactttttaaaaattttttgtagagacaggagtctcactttgttgctctggctggacttaaactcctgatctcaagtgatcctcctgccttggcctcccaaagtgctgggattacaggttattttaaagtactctttttctagtgcacacgaagtatacactcatcataaatgaattataatatagagttgaatgactaaaacagtcagagagatgaaaatatagataggcaaacataaatttatttttcaggagacaagaaatacacacacttcactcaggtgtttaacttccccctgctttttttttttttttttttcactaaacagcattccatgagcattttttcaacacaaataaatgcatatacttactgtatagatagagtacaactcttttcgactatttttgggtatgcaggttgcttccagtcctccactattataaatcgtaatgttcataatcacctttacgtcattacaattaaatgttggtatgttattctaactcgtctgagaaaaccattccttctcctatatccagaggtaaggtttagctgccttatttcactaccaggcacagggaatggggcttttgagaaactagaaatggccatttcatctgacctggaacctaggttcatgcgaggcccctgtcctctctctccaggtctctacgtttggcaggaaggcttggttctaatcatgcttcgccttctaggagttactccggagctccatttccttcttcctgtcgtggtaggggagggaagcatttctttgtgccaaagaaggtggagaatgagagggaagggaagacacaagggaccagcctgacaacacagaaaacgctgacataaattaatcaaacgaggcatctcacaggattgaattagttcctgatttatggccgcagtgcagggcctgccaggccgtttctccatgctcatccgttgctgcccctgatttatgtcagcgtcccggtgcattggctgactggggatccttgtagaatggatggagggagagggctgctccagtgccggccggccccggtccaatcttcattccagccctcagagtgcagacccatttatcaacttcattatttgcctcataaactcaaggcctgcatctttaggctctgtcgtattgctatggaagctgggatggggaaaaagagaaaaacgtaattctattttttctttacttatgcattcttagagattcttaaactgccacaggattgaagctaagtcggtgctgatggttctcgttattatctgcagggaggtgtctacccttacgttagcctcatcgcgttactgctaatttttgcaatgagaggcatctggggggtgatttgaaaggtgatgtgatttgaatgctggtggcttcctcctttggggaaacaatttaccactgcaacaattccttatagagaaaagattgttggggacactctgctgtagattctaggaatccatctgtggctagtggttgctcatttatttatttgttcactcgatttattattcttttaagttcttacagtgtgcaacatactgggatctgtactcctatcgataccctctctatgagtctcagactccaagaatgttggggtctacaagtagagacagatattaaacatattaaataatcatgttattatagctgtaacaatgttaatgataacattctgagaaatgcttcacagttatgtggactatttctaatatttgaagcaaacatggaagacattttcttaggaattcatatgaaatattccctcacatgtaatttttttaaagcatgggtgtggttgttggaaatggctattaccacttggaagcaagcccaacgtaaagtggaagattaagttcactaataataactttggttcagaattgtccaagtgatgtttgattattaagccatgtaacttttcataaaaattcaactttaagtgttataatttccaaatctatatcccaggcaaaagattcaacatctcaaaactcatttttctcacttccaaatagtacttaccttatacatttgttgtaaaattaaatgagataacgtatttaatatatatatcatgatacctagtatcttgtaggtatttgaccaatgtctgttacttagatttattttttcttgcccagctctttctcctgtgttttagaattatatattgttttttggacatcattaattggacatcctacagaaacttcaaaatcagaatattaaaaaaaggactgagttttctcactcaaatctgctcctcctgctgcttgtcggatacaaataaatctgactgtgtcgccactgtctacacagatgctcgagttcaaagcctggtacagtctcccacccacactgtcccatgcctctaggctccagccatactgagctctttcactttcactaccacgcctgattctccctctctctgggcctttgtccgtggggttttctctgcctgaaacactgtcttctcttattttaactatttttctactctgcatccttcaggtctcaggtaggagtcacttcttccaagaagctttcttaacccttcatgcttctctgacaggccttttctaagcactcggtgctgtcttgcactgtttccaccacagcacttagcatattgtatggcaaatgcatctgaattttttctactgatccatgatctctataattcagtaactgtcatgttcatcacctcgtgtccccagagcctttcatagattgaggagtaggtgcttggtaccacactactgaatgaatgagtctatcttcaaagtcaactccaatagaaaggagtttcaaaaataatttaaaggacactttaaattaaaggagggttaatcttccagttgagttcaaagcatctgcatttacatgctatttccatacagggagcttctgctatgtattcaaataagcagcctccatgattcacatgctatggaaggaacagaccagcattaaatcaattccatgaattttccaataatgatgaaataaaccaaccacacttgcagtacctaggttccagcccctggccttctcagcagcatgccttcttcacctcttctctcccctaaggaggttcttgtaccctgggaaaagagcaatgattcttccagcccccaccctttgctgtttctttgacatctttcaagaattgcagtgttaaagagcactttaaatgtcttggtctcttctcctgggagagcagatattcagaaggattcttcactaaaactttgggaaaagacaagcagtcttagagcttgactgtgaaattctccccagacaacccggcatcagacacagagcaaacagttcgagcgctggcttcctgtgggatattgattttccctctctgctacagcattttcctcatcctcttggcatccactggaaaaatgaaacatgaggttttaagaactaaaaatactgagtgacagactgttctaacactatgggttatatgagaattccagctgagaggggactgatgtggcacacggttgcccttcaggggtcatagagtggacttttagactgtggagcggattgaggcaaataacaggtattaggaagggcaagataagagccttttggaaaagtggacaagaagagggtcgagaaagcaaatctggtgagataatggaagacagagataatgaccccacaaagcaaactggaaataccttcttgaggtgcttttgcagccacagaattggtaactgcagacaggaagaaaatgggagtttggatggccaattctcaagtaaaacaaagaggtatagggccagcctcactccctgaaatctcttcttcaatttggcctttgtcagtggatgactttcagctgtcttgctggtgaggtctccacagccaaggctaacaggctgagcctcattcctacagtctatctgggatcctgtcttatagaggagagatttgagaaactcttgcctaaggctcaggaactctgagtctccccagggagtctgagtccaaatttctccttactgaccacttctttgctcatgaggagctggctaattgtgcttttggggggacaagttgcctcccagctttaccaggatccagctccttctagatggagagggctgtggctccaggtagacctttcctgtttccagtgttggggctttgtaggcctgtggcttctatgggtggtgaggtaaaatgcagaacactcatttagacttaaattcagataaacacacatcattttctttacattacatatgtctcatgcatttaaactaaaactcaagtttagctgattgccttgtatttttatttgctgaatctggagaagctaacccccactcacaactggatttctttttcttttctgatccatgacctatccagtttgatttcaagccttgctatatccttttttgtttgtgtgtttgtgacggagtctcgctctgtcgcccaggctggagtgcagtggcacgatctaggctgactgcaagctctgcctcctgggttcacgccattctcctgcctcagcctccagagtagctgggactacaggcgcccaccaccacatccggctaagtttttgtatttttttgtatttttattagagatggagtttcactgtgttagccaggatggtctccatctcctgacctcgtgatctgcccgcctcggcctcacaaagtgctgggattacaggcgtgagccaccgtgcccagttgcctggctatatccttttattctgaaaagtaaatcatagatggatgggtagacagacaggtagttaggtagataatatttgttattgcttggttgtaagagtagaggggagggttcacagtgcatattcattgtacagcttgaatcacaagtttgcttaattttcaaaaacgtgcttctcaaccttttataactttttttttcctattttaaaaacagaaacactcatacaatgttctttgatcttcttcatagcccacaaacaaaaatgattttatttagctttaatttttggtgctcatattattattaaaatgtttacttggctttcaaaatataaaattataatatgattttttcccaaattacatatatcaccattctaagtgggcccccaagaagatgcatctcaatccatctctttcaaatgaatattaactgcatgtctccaagaaaccttctcagactcccttggggataatttgttgctccactgatccacctgtcaacccctattaaaatatgtcacctgtgtatttgtgatctaactgaacattgaaatgatcctggaataattttttgttttgttttcgcttctatatcccaggcttttgcaaacctaatacatatgtgtatttaataaccttgctaatatgtgattacaacaataaagaacagtgattttacagcagcaaaacttgtatccagagaaagaaataattggctctctgaagttagatttttgactgaaaattggcagagattagtgcctaataatcatttagttttgtttctctcatctgtgcatgctatttatttttgtttaattttttaactcagtaaaggatcatttccttctcatgtggtttttgtgagctaatatgacaaaatagttaagaaattagcctctggacccagccaggttaagttcaaatgcagacactatcactttccagctgtacgatattgggaaagttgcttgatctctctgtgccccagtttctttatcagtgaagatggaataactatagttactttttaaatttttatttatgtatttattttttgagatggagtcttgctctgttgcccaggctggagtgcaatggcgcgatctcggctcatgcaacctccgtctcccaggttcaagcgattatcctgcctcaacctcccaagtagctgggattacaggtatgcaccaccacacccagctagctttttgtatttttagtagagacagtgtttcaccatattggtcaggctggttttgaactcctgacctcaggtgacccacctgccttggcctcccaaagtactgggattacaggagtgagccaccgtgcctggccaaataataatagttactttctcatgcggttctggcaataatgtaacatgtataaagaatttacaataattcctagaaaaatatcgaacatcagtgtccgtaattagggcatgctgggtatgagtggtctagcttttgtttgcatactgatctttacatttggaagatccattggttgctgaatgcctttggaaagatgtggttcttaggcaagatagaatcaactaaggctagctacaaaacaactcaccataaattttataaactgtaccatattttatatttacttattttattacttaaagtcttctgccagctcaactctgtaatttttctttttttacatgacaccaattttggtcatttcttattaaccccaaaacaccattgaacattgggccacaatgaaaccttcatgactggctctttctgaccatctagtcagaagaaaacaggaccatattggcataatcaccttccccactcctctttttacccacctgctctcttccccccaagccccagtttccctgcctctgaccttctagagacctttctgctagcagcaaagcagtctcattccaggaggaaagcacatccctggagtatctccctggtgtcatggctgctattgcgcaattcggggaggcatttcactggtccagtgttaaggatgctaaacatgacctagcagacttaatggtcacctacagtcaagtgaagccttccaattcttctccttgggagatgggacatcattggatcactgaatcacttctcactttttcccatgggaattcattgacacaccttttagttttcttatcttctcttattataaaaatgcagaaagataaatgaacctaacaccctaagggggacactgtcttctgcaatttgctagagagaaggaacgagagtaaatggaatgaatgagtgaactgaaagatagataggaatgttaaggaaaaggatacatcaagaaaatgcaagtttctggttgggtgactgggtgggtggtatagattgagatagagagaactggaaagaaatccacggagaggagaaaaagtgttagacaagttgtgttggagtgaactgctgcagaaaggtctgtctgtgctgcaatacagctttaggaactccagcatacccttgagatctctgatcaccccacagtggacgaatcaccctggagattatgcagaaagaggtagccagggcactcaaggtgaaatttgggaaaaccctgatattgagctgagatttccttaggaatggaaaaacttgagctatccataacctgaaaaaaaaaaaaaagagaaagaaagctggcacaagaaactcccagagacattgctaacctttgacagggtccatagtggtcagagattttggcccaaattagaaggcaaccagattctagatctgcctggaattcaatggagttcggcaagaaaataggattgtgttgaccaataatatctaacttgggtcttgcagtttcacatatggtatttattttgtatttctcagaaattctgcaacctgggtattatcattccaataataataacaatattgataatataataaaataataatgatgatgatgagggaagcaaagacccaatgggatgaggaagcacgctggagaaatacaactaattagtgcccgagcagccttccagcgccggccaccaactctgaatcctctcatttttacagaagacaccgtgtacctctctgctttctcaggacattctcttgtaaaccattttgtggctgttcagcctctttttacttcctacttctaggcactgatatttcattgttctgatgagaaccctagactgataatgggaggacagggaaaacaaaacactgagagagaaaaaatgcaagcctatttgccattaatcacacacttttcttctagatagcgtgcaagccatgcaagggcagtgatccaacacaatgccaatactcattgaactgaattgctaagaggttctaatgctccccacaaagaggacaggtctggtaattgcaaatgagtttaatctgtttcacatctgaattatcctgggcttagtaaccaaattggcttgcctcttgagtttgtcaggtcattcttccctgtggagggagaaggaggtctgatgaggagcacggtccggctcagagccagcctgcacatcaagctggcatgcatcgcacacctatgcaggcaactcaaacacaattctcggcaaatcttctgtcatccccatctctactcccagcagaagaaatcactccttcctctgtgttcccataacatatgccaatattataacattaactacaccacacatagaaaagtattaaggtacagacactggagttgcacatcctgggcctgactcccagctctgccatcaggagctgtatggccttgagcagatcatctcatctttatgtcacagttccgtcatttagaatatgtggatattaatagcacttactactacctggctattgcatggagtaaatgaactagtgcatgtaagggacatataacagctcctagcacctaggaattactatagaaatgctagttactattaagaatttatttagagcactgactcttctactgaactgtgaggatcttgtaggcattggtcattccttaatgtttttatatttttttccccaaagcaagcttagttactgctggttaaaagaacagagtgactttcatataaaagtgactaacacagcatctgacaattaatgaatccagtgagtgagtgaatgggtgaatatggagtttgtggaatagtagttgacacagaataggcattcgctaagtctttcaagatgaagaggcattgtcttcatcaccgaggcatccgctggccttacagctggatcccactgagtcttcaattgcttttattgaggtattctgcggttgtggtgtcctaggtcagattcttcttgtgtgggatttcagggtccagggaccagggtggtctggagttgtcaaaaagcatcctggagaaaacacgtgaagtgagcttcaagaatagaccagtaatcaagagcctggggaggagagagggcctgccagcgcacagcttgggtctccttttgcttgatgctgtgtgacaaaacaaacgtaaaacacaggaaacaaaaagctgagggcacagcctccaccctcggggaaaagaccattatgttaattggataagaacttggaggaaatttattccaattgacctttaactaggagaaaatataaaatatttgaaaacttgggaagtatcaaggccctaggcttacagacaaagagggaatgagttcctctgcaaacccagaggagctgggttgtccaggcccagggaaaaggaacccttcgttgaaacaagggtccctggccagggagggtctccaggaggctcctgctgcagccaaggtgcagagttttctggatgaaggggaggggcccttccagaccctgtatacctgagtccctgggtctgagcaagcgtgaccctgcagaaggcctttctgcacagcctcagcacctcagctttggcacaggaaaaccctcgtcccagtgcgactggagagacagaccatctgcctacaccaagcctctgcaaagcccagcagagagctgaggccatgcggctgcgcggcagcttgctggactgtggctcggctcactgtaagtgctctggctgtgaccaaatcacaaatatgttttgctctgagtaccttcccccttaatttttaaatgtatatgtatttcaagggaaatgaaatccatgggtttctagttcatttacccttaaatcattaaaatgctgtttaagaacattaggcatccaaggagcttttccagctattctaataagcatttgaaagactcttttctcccctcagggacagtttcatcggaagcaaatggactcagagttccagaggatgcagtttggtttggaattctatgtcaatgttttatgtaaggcaagggatcctaatcctggtgaaatatacaatcccctcagtacagggaaggcagaagaataattctcttgcttttactgactttgggtctaggagagcgcctttaacttacacctggaattattgaggaataaattgaacaggagataacatttatagagcactgactgcataccagctcctgggctctgtgccttaatgtctgtcatccctacataattacaaggaaggaattgtcctcgttattcaaatgaggcttagagaaatgaatcctcttacctgcggtctcgagtgatggcacctgaatctatcattctgactcgaagctctttcccatctcatggccttggacattttcccagggtaagagtaccagctggcttttcaaagcactgacaaggtgcccaaaacattaccaagaacatttattcattcatttgagaaacatttgttgatggccccagttccaggcactaagttagtactcatactgaccccgcaagagaggcatcatagtttccattctacagataaggaaagggtgggtgtgttgggaaacaaggctcagagggtctgttacttgcccagagccacttgtctttctgccacttaccatctgaggcacagaagctgcaggcaaggggaactcgagggcactgcactgtggctgctctgatccgagcaactttttaaaagtgacttggtataaggtcacttaatacaggagcaagttagctcatgccgtgggtggcttcaaagccctgccctttgtgaaataggcagaatggctgctctattttaagtagaaatgttgcgtgtaagacgtcaaccccttattggtagagggggagggacaatctcattcagttcattaacaggagagaatttatccacataacacagaaacactaagtcaaaagccgtatgagagatttctaatgaaagtctggttggggttgctgtgtgagcaaaagtaaaatgaaatttgggagggagtaatggcgcctactcatttgaaccgcagctgctatttctctgtccagtataattatagcggaattaaaggagacaggaacacctctttgcactgctaaagttaaaaagtgggtgggagagcattctgaaattagtccttcctgcaacactcacactgaaatgtttggagaaaaaggaaccactagagggtgctgtccagacagccagaaagacggagaagaggctgtggtatacaccatatactgagattgtcaggaagaaattcattcaagaggtattgcagtggtctgtaactttcaaacaaactattattcctgaatgactcctgccttttaaacgtctatgaacatgccccttcctgtctggtaggaatgagcctttgctttcttcatgggatgggtgagagaacaattttcactcttgagcactgcctcatattttcctggtatgtgctccaggattaaactttcagatttattacattttctatctatgcaatttttgtcctaaggtcgtcacagcaaacacttccacagagtctcggaatgttttataaaccagtcatgcaggaacacgtgctgtggtgtaacatgctgcccccaaattagagaatgctcagcttctgtccagcttgcctagcatctgaaataatgagagtggcaaggctcgtaagagaaacggaaacacaagaaacatattaagacctggcacacaaataaataaagtttaactgcaccaatgtcatctcacagtgggaaagtgatttctaaaaagttttcagacacactacctatgttatcattgcatctttgtaatgacgtcgtgccttaggagagcctttcttatcatttcatacactgtaagcagaggcccaaggtggcaaggtcaaaaccgcaaggctggttactagcagcgtcaagattcaaactctggctttcttttttctgagtctgaaacactcgtttcgctactatgaaggatttcttggttttcagtaggcatactggtgaaatagattcatctgggatttctggtaaggaaacaaccgtgtatgcatggagcagctgaagcccgtagcagaaggggaaacacgctagcctctgctatctttccggctgacacaaacagggacccttttcctttcttccctcgtggctgtaactgcaaagtttcttgcatgaggacactgtcatgatgaacggcacccctgtttaccaccaaatcgggttgatgtggccggcagtgtgtatgtttctaaacaagccggcagcggcagtcccagatccacaccctctctccctgcactgccagcactgacatgacgggaacctggccggccccccagccaaagcaagatggattgagatacagaactttattttctttttaagcaaacatgagctagagttgctgtaactcagccacgttccattttatcttcatgttaatgaaaccgcacagcaaaattctggggcacgtggagggcaaagtccgctgcctgctcaccagccctgagagtgccttcttgttgcttctgggccttgtcctgcacgtctcaaaggatatcgcccatttcatggcctgtgaggccatcacacccctttagtgagagttctttctctccctctctttctcatcttttctgcagtgtagacaatttgcatgcactttcccttacccctgccctgccaagatctaggcatggttgatagtgaactgagtagtgttcaaattggaagaaaaagaaaatccctgtccctcctttcagtggttgaggaagtggtcaatacaaaagatctatgtagcatcattttatacaaaaaaaaaaaaaaaaaaaaaaaaagacagagactgcctctcttacctgttacttgttgtggttatccctgatctagcaaggaaagtgtcactggagggtaccgggaggcaggcactgtgctgggttttgaaaatggttttggttgtgctgtttttcagcattgttttcttctgtgtcaaaatattattcatatacttggttatagatgcattgaaatcccaagatatgcgtagaattgtgtttcttgagggtaggagatacaaacaagtatatcccactcaagattatatatacatatacacatacatttcctcagttaataatcaaattacaatacagtatatatttcaaacttctccatttgatgtgagttatgggaaatgctaagcactgtttccattatgtggtgaacctcaatatcggccagctgacagaactcttcgggatcctctgtaactgttccctaagctgtcctgccagcctcacttatccctgcaaatagactatctttctgccagctgccactcacagctttaaatcccacgctcctgtccatgctattactcagttcttagaacaccttcctcacgcttgtctacctaccaggaatcttatcttctaggacttaattctacgtccattacgaacactttctgtcatcacttcactttgaaaagctctctccctccaaattccaataacactcatgccactcgatatctcctctgttgaattactgaacttttgttttacaacatgttgttattatattttctttgcatttttatcttgtcactgcaatcagccaggatggctgcctccaacttcccctcagtcccaaagccacagaaaccacaataaaacacagtcaaaggtgtgccctggcttgtctgaacatcctcctgtggattccctttagtcgattaagagataaagagaaaggtaaggcaggagttgtgaaattcccattcggcccaatgcctgccccgcaccaggcctgctgcctgatttccatccagctccatgtacctgggccggggctgcttccagggcaggcctcacaccgtgcagaacatggcagcctgcttgctcagtaagcagccacgtggtgctccggccctccatatgcttccctggctttgtctccttcccatccctcagcagatctctccaagcctctccaggatgaatgcaatgtctagctctaatggtctctgagtgtcctgccaggacaggagcaagtccagtccatgctccccaggctgaaagaatcccaggccaaatctggaggggtccctcaccaggctctcagtccacagagatgctgcaccagagcagcgttgcagaacagaaaactggaaggttgggaatcagggaagaaggttgggaggcaagatgcaagggcataaactgcccatcaagttggtaggccaatgtagcaggaagcctaggctcaaaaccagaattaggaaaggagaaacattgatgagacaagtcatgcttagctccaaggaaggctcagggcaaatgtagcaagcaggtcagtttccagaacaatctgtccaataggcatttcagtaaactgctgactttacttactgtctactgctgagttgactcaggagtaaactcctggggctattcctggggcaggaattgggagtgtcacatgaacgcctgcacatagtaagtgctcaattattattatattctatttcttctgatcctccccaagggcaccaaggctgtgggaatggttgttcaccctggatggatttacttcgcccctcttggaattgctctgtttttcataaattgagagacttaggggcaagatattatttgtgtctacacattgcacattaaagttccctaagagttctttgatgaggatactttcgaatttctgaagtaaagaaaaaggtaatagagcacataatcctttctgtcaggtttgtataaaagacattatgtgattaagccagtgtctgcgttccaggagcctgcactcagcccacatgagtttttgattgctggttctgtctgtattgtttgagtcctctctttgattctctattcctaagacaaggctgaaaccacaggaaaccaaaaaggaagccaggtaacaaatgttcctcagagaggtgaagccctgtggatgagaactcgcgtgccctggggctctgtgggctgtgatgctggaataggtcagggtgggcacacgttcttgtgcttattttgcagctgggctttgggagacagggagacattccacaatggtggagccattccatattccaagggtgacagagccctgccttccattataggagactacgacaatgtttgtcaatcttcactttccttctctacgcaatacagatttattacttcgctcttgaatgcaagattggccgcatgacttgctttagtcattgaaatttgggcagtagtgactgtgtgaattccaagcagaaattttattattcactgcatccctgtcttccctctaatgtgagattgacaatctgccatttagtggcccctctgtcagtcttggtgcagagcaaataccctgtgggacagaagaatgtgtccttgtgagtgagaagcacatagcttcttgccactgcctctaacatttagggccacttgttgtcggatcataactgaacctgtcctgactgaggcatacatcgtgccccagggacctctgacctctccctttccacaggagccagaacccagggcagagccctcatgggaatgaagcatcccattcagaaatgcttgtcgggatgcagagaatgggctaacatgttttcagatgcctaggtcgtgaagatttctaaaaaccccgcatcttatcagtctcactcaggatcagcaaaccaccttatttcactttccattagcttgggagtgctttgcagaagagagaagaaaaggcaggaaagacttcccaaatcatttcaggaactggagagtgatttcactcatcttattaacaagcctgtgatgaagggaacatgccacctgagtgtgcaattcatcggtgtcactgttttgcctggttcaaatcaactatgggagataggctgttgaccacatttctgccctcgctggtggtacgaatggccccctccagacaggaggaaagcagtcagccctccctgagaggggttcttcaggatttccttcccctttctaatgaggggctttcatacctcctagaaattttttttaattttcattttattttattttattttattttattttattttattttatttttttaattttatttttagacagagtctcactctgtcaccaggctggagtgcagtggcgtgatcttggctcactgcaacctccacctcccaggttcaagtgattctcctgcctcagcctcctgagtagctgggactacaggcgcccgccaccatgcctgactaatttttgtatttttagtagagatggggtttcaccatgttggccaggatggtctctatctcttgacctcgtgatcctcccgcctcagcctcccaaagtgctggtattacaggcgtgagccaccatgcctggccctggatcttatttttagaaatgaatctgagataggaatatagtatttgtattcttgacaccttccttataattatcatttacttgatgagattattgctttgttttgggtttctcaactaagcctctcattatattttgttcggaaacacaaaccatctttgggtatggggaagaggacttcatttcaggaatcggtacgggaagggacttgccacaccttctagaactgagtgcgtagaacgcaaaagtccaacaatccagcccctgtcggtaaagccccaaatagagccaagcacctgccactgctgggaaatgcatctctccacccttatctttttccagagccaagttccaaatgcacattgaagacaaagctgaaatgtttgtttctcctttcccctattatttttcaattttctgtggctctgcacttcctgctggccctcaccagagacctgaatacagatcccagagatgcagcctcttgtataaccagtgccccccggggcaagcagaatgatatgtttttggagatgtgcattttttctttgctcattttcttgcatcaacgcagaagaggaggtagtatggggtctcagatttttggaaagtaaaattaaattagcaggctaggtggacacaccaaaattggacaatttaggtcccattttccttgagttgtttagacagatgggtacaattttcacttgcagtttgatccaaagggggagttgatgactggttctgaaatgagcttcctttatccctccgtgagctagttggaaagatgcaaagcagaagcccaggaagctgctaaccaaggagatggggtggcagagaggggagctgagaaaaagcggaaggatgggcattgctgataactcctcagctaagcttgctggtgattaacctggtaataaaagtcaactctgtgagtcaagcctggatatgaagagagagcccaaaatgggtataaaacaatctccctttgcttagaaattgacagctgacgttgtgtcccctctgggagcctgcaggaggcagcccagccctgctagcattctgggagagctccgactgcagctgcctggacctgatgaacagcgagatgcttccttacaaactcgatagggcaaaagttttatccgcagcttttaatttgtaaggtcttgtgatggtttttcataatgatgacagcctgcccgtggtgcccgcagtacaccgtgtgcgcgccgactttttcttgtccttcagcaagagctattttgctcattagcttcagtatgagggagaaattgccggctccctctgaagattttgccattgggtgacctgataagcagaatgcaaatgtgcaaatgtagccggagcccagcatctcgtatctccgtggctgtaaggatgcatttcttaagtggtttcatgagctgaaacgtgtggggtgagcagggaacaggctgctgtgagtgctgctgagggggtttgagaggcagggtttccaggtgttcttagtccagctccagcaagagagaaactcttaggtgtcttactcaggttttcaggcaattcatttacagcaacaacaaaacgaaactctactttttgttctgcttgcttggtgttatttttaattttagttagaagtagattttctgttgtggggattccaaatagacatttacccaagggacaccatttaatagacatcctttgcaataaacattggattttcttcataattctttataggtagccttgtggtaaattgttacatattacttttattttatgaacaactcaacaacttttcattagctcctattatgaggaggattctccactaaggggtgatgcagaaacatggctcttgctccccagaaagtctcagcctagaggcctgatgagaggagcaaatagagatgactggaatgcatgtgctcagctggctggtctcttggcgtaggttctgggaattctgggaacatagagaagggtcaggaaggggctcgccctccccacagacagtggcggtaaaactgagtcacctaggctgaggaagagttggctagatagagaagaaaaaccccgtagaaatctgtgcctccaggtggctgctaggatcttgaaataagataggcagggtgaagggtccaggtaacatgttgagtaagcagggggcagtcattctatagcatgttgtaagagggtggggattagataaggatcgtataaaaatgggagctctgtttaccatgctaagaaattgggatttcatcctcaagatcaaaggatgactttaaaaattgtgtaaggaggggagtgataagatctgattagcctttcataaagattcgttaacggcaaagacaatggactggtgagaaatgaatactggtggcagagtgtcttgctctccgatgggttaaataagaaataagatcccgaccttgcaaaaagacacaggactagagaagagggtgatttgagagatactcagtaggtacaaaggtcaggatcttttaatagtttggatatgggtggtgagaggaagaggtgagcagggatggtccccaggattctgattctggaaagtgggtagatggaaagctgtgtccaaaatggggactggaggaggaggaatgagccaggagcaggcattcagagaggagatgtaggtgtaaatttaaatctgcggagatgtcaagtaggcagttgaataaatttgagttcagaaaagagttctggcctgcatgtagatatggatatagacatatagatgtatagattatatatagtagcctgctcggcatagttaatctgagggtgtgggctgggtatgcgggtgaagtaaggaggcttgggggcctttgcatgcaaggaattgtagaagcccaggaaagatgaaaggaaggatatggccaaaaaggtggagaaactgcaggagctggtttcacggaagccaaggtaggaaagtgtttggaggacagagtggtcagaatgatccctaagaaggagacgggtggtgaaaaatgatcttttgaaatttacaaactagagctcttcagagctcgacagattcaatattacagtagaagcagaaggcagatgatagacggaatgaagggtacagggaggtgagaaaagagaactccaaatgtagaccactctttcataacatttctctgtcaaaggagaaaaggtgatgcattcaagacagtaaaatgaaagcagggatggaggcaagtaaagagtccctcctctcacagactgttggttttcactagcaagtatttcctcctcctcctccagttctctgctctggcattaagagaccttcccagtagcataagaggtgaatttcccctcaagtacatactcagagtgtgcctcctgtggaaatcctcagcaatctacactaacccaggaataggataaacaggttgcactctaatcccatcttgtatcactcttctggaaagacacaagcaacggttctggtgcaaagttctctgagataagaaaaattgcaattcaaggcaatgcagagccgtgtcttccgttcacagaaactttgattctcatctttgcaaagctcagcattttactatcctcctcgctattcttcctttctcaggcttcacattccctcctcttttttccttctccttctattggccacctctcagtctgaactctttctcacttcccaatgtcccctcaactgctcatgacatattttgatagtattttccctcgaatgggcttgaattgttttcctaataagtggtgttcctctgtaattttcaggcagcttgttaagatactgtttttttttacttctattcttttttattattattattttttaatgctgataattaaaaataacaatgggatgaagagaccttttccccaatgaaacttcccaaatttttggacaaaaagaatgtgacaaaaccttatgtaaaagaatagtcataattgcagaacctgttacaaaaataaaaaattctaacgacctgagaaaagtaagggtggatatggccactaaaacatgcacttttattaaatttagagaaggaattcgtgatttgaaggcattcacgatttatcagaaccctcattttgtggctttttgcggggggccagggtcaggtcagcctgctcatggcaacttcctcaattttttttttttttttaatcagaagcatgagcacattcgtgcggatgggaatgacagcaggagcctccctcctggctccatcctgctccgcacatcccctagggaccctctacagatgagcgtgggtcctctggtcagagatctctgtgtgagctgctcctattcaccctctctgcagggtgactctggtgaatgctgggccctgatctgccttcgtccttttaaggattgcttcttctcacccagggtcctccaaccaaaaagtgggcacttccgtgttctcggtgagaagtaaacaagtgtcagctgtgacaacgtgtctcactgtcttacctgggaatgcatctcagcaagggaactccaacttctatatccagatggagcccccacgtgtgatacttcacatctgtggggtagtctgagaagcacgtttcccagggggcagtctattctatagcaccttgtaagagggaagcaacctccttcccttatttctccggttttaaacagaataaggagatgggaaagtggaggcccagggaaaaaggtgcctggtgtggaggccagagatgctcccatcagacataagcccctctgctgttaccccaactctcagggaagaagagctgagccacttagagtcttggatatttccagtaggttggctagtgtcagaaaggccagctctcgagtgagcaggcccgggtgcagagagctttgtagcaaaccagcaagaagctaagatgggttccaaggcaacctgagctctgagagccgtcctcccgtggaccactgcagtgctccttccgtgtggacgcaaatagctgagcgatgcctgagcctaccatttgagcagctgggttctcgccttgtcctctggaggactcgctctcctgtggagcagcctctctgtgactcctgcgctggtttcatccagccataagccctccccgtggttcatgccggagctgacaggaaacggacttccacctcccccatcttccgagaacgcctctgggtatctggctgcggggcaggctcccgtctctcccacagctccagtaatttctagcgcttttctctgagctgctgcagaatgtgggaggcttgactcagtcctgatccagatgccaaagcgaaactcctccagagccgcccacaagaccctcgcggtgccccttccagggtccaggctgcagggaccccagggagaaggtcaccccgtggaacacacagcccgctgtggagactgctccctcgccaatcgctgccaaggctttcaggctgtgaaatgaatattttattaccttatgaaggggaaaaagattaaattagcaaaatgatgataaaaaaaaaaaaaggataacctgacttcaacccttttattatgcttcacacaactagacagcaaattgcgtgctggggcttcggcttagatggctgtaaagaatctaacttttgctttcaaattaacctgtcaaatcatatatttataaaggaatgaagggaggaaaatgaggggcctaggtagtcccacgcatcaattagagagaaattaattacaatttacctgcattagcacgtgaacactcccagattactgaagaaatgtctctgcaccaggaaaagagtcaaaacagaccagtctgtggaggttggggggggatcaggagggaaggggttaccttgggtccaaggtgggagtggagaggattagggagggtgggcattgcaagaggtatgaaagaggccggcaattagacattcttcccggtcgatgtggatgcagaagtctctaactaatggcatgttttgatgaagcaacctttaaaggaaactccgagttcttaaataacgaagtgggcactcacatgaaacaatgccacacagctccagataacaatggagttttgcctactgttgataagcatcacaaaatagaaggcaaacactcttttccgctttcttcggggagctgagtggtaggggaatcagagtgggagtggggaggtaaggaaggagattggaaggggtatctgaccctctttttaaatcattcctctttttttgttcagcggtttggattctgaaggaggttaaaaataagatcagacagtttctgacacctgaactccaaggtagaaacaatacatgggggataaaagggacaactagtcatcagattataaactaaatctctgtttctgttcctcaacaactgtgaacaaaaaagatgtcattgttcttcatacaaaaatcaccaaaaccctctggaaggtcaagagctagaagcattctcttcctgggggatcctgccaaggcactctgaggagtcccaggtgtcttgaatggaaggataatggtttctgagggcctggggtcttttttcagccttggggatctcagttgagatttttgctgaaatctagagaactctagaccaagattcccacctccatctcctgctcttctctcgagaagccctaactgatcccgtgatagaacacaggtgggaaccaggagcagtgtccacagggtgaagaatagcctctgggacagagctgtggagggtcagggcttgggctgccagcaaaccccaaactagtgaagatgtatttctccttaactgaaaaattagattaatcataactgcactttcctcatccaataattttcagggatcaaatttatataccaaagctcttttataaattctggacaaggtcatattgatacaggctcttctagcttttaaaagtgtgcttcttttttgaaaaaaaaatacattctctttttcctccttccttcctcccccatcttcctgcatctccagcagccaaagggcaaaccagccattgccaattgtgtgggagcctctgaggcccattagatccttgttttcctcttttaaagtttttttctttttcccctggggttcatgaattattattattattattattgagacagagtctcgctctgttgcccaggctggagtgcagtggcataatctcagctcactgcaacttccgcctcccgggttcaagtgattctcctgcctcagcctcctgagtagctgggataacaggcgtgcaccaccacgcccagctaatttttgtatttttagcagagaccgggtttcaccacgttggtcaggctggtctcgaactcctgaccttgtgatccgctcacctcagcctcccaaagtgctgggattacaggcatgagccaccgcacctggccgacgaattattaatgtctctgaaatagctttggaggccactctctttctagaagggttccggggcaggggaggatgtggcttcctgaggagctctcagtccttctcagctgccctttgggtctgcacatgcacccatttgctcagccctgtggccatcccacacaagctgaccacttctgcagtgtcggagctggaaggcacactcatttttatgaccaggtctacaaggtccattagagagattcctgcaggtttctttcctggggaaagaaaagagagaggaggaagattttgtaagatgccagggcacctttgccgacactgcacagtgggtgctggggtggagtggggtcttatagtgccatgaggcagcctgcatcccacagtcaggaagctatcaggacagtaaggggccaaggcatcaagtggcttcaggttttagaggacactgtaaggcagcatacggtgcatggattccgaaaacaacagccatgggctcaaattcctgcagctctaatttttacagaggtggcaactgaaaacagagggttcagagtcctgggttgaaaccccagctgcaccatttcgcacctgcatcaactcaggcaaatttcataacctctggaacctcagattcttcatctgcaaaatgaagacgatgacagaagccctcagggctgttggaggaaagggtgagaccatccatgcaaagggtttagcgcagtccctgacatggagtaagggctcgatacacattagactttgtgattattactagcatgccctaaatgggcacctgatatatctggaggctgtgattcctcatttgtggagaataaagacacagaaaacatgtttcccaagaccactatttaaggtttaaatgagataacaaaagaaaactgctgtggcctgggcctggcccagagagaaaggagtgagtggaggtgggcagtgttaatcaagggatgctggctggagccctctgtaggcagggacggagttctgggagaacacaagcaccagacgcttcccctccccagtgctgagtacaagtgctccggcctcttgaagagtgatagtgactcaactctggcataaccacctccctgctcccaaagcaggctctacttttatctccccagacgatcctcctgtgaatggtcaggctttggatccaaattggatgtctgctgttgagaatgaaggattactgagctgatgggatgtgcccagggtggcctaacggtcagccagacaccacatgacaaaacagcagcagcttcagtgagccagcagcaccatcctcaactgcacatgctctaataactaattggacaaagtttccacagccgattatcaagtcaaaaactgatatttcttctgtctctggcaacatcaagcgtgcgggtgggggttgagagaatttggaggtggcaaccgacttatcagggacacactaaatggtagaagggatggaaaagaggagatgtaaattgtatgtcttctttgcaagtaaattaacttcgttttactttaagtgggaagcctagcagttgcctggggcctctccttttactggcttaaagaggcaggctaaaaacagtaggaaagaacatttgcagggggaaatatatgggtgatatactacaatgtcaaattggaagatttcctcatatccacaaatcaggattcatctgaatctcccgtaggacctgctccaaatgtcgtccgttaccagttcttaatttatgttgccccatttgcaagtatcatggtgcgtaacaaagttaggacgaacaaaccacaaaacctaaataacagaccttcagagatgaagaggacagccatcaatttagatttttaagctgctaagtagaattgaggtggctgtctgggtctgttgcttttcccagttcagagagcaggtgaagtgtggtgttcaaggaaggaggggaagaacggctggcagtgggtgagggaactttttctccactctcctcctctaccttaacccctctctccttctcaagactgaatgcatcagcctgcttggttaatcaggaccctaaatcctgaagtatggtggatgctgcctgcccagtccatcactctaagccttccttccttccctttttcagctgtcatctaaggcagcttcctgagtgccagggtggaaaacatgctgtgctcagagtcagaatctgagttgggtctctctgatcctggacagctcactgaaactctggacctcgtctctgccatttgtagagctgggacaccagaaccacttcccctcctcccctggagggcggtgggatggagcgagcgctgaagtgcgcatggatgtttcagttcttcgccccctgcagggcggtgggatggagcgagcaatgaagtgcacatggctgtttcagttcttcaccactcctctcttctgtctacccgaaggccagtctcctgcaaagtggacagagattccaaaccagtgcccagggctgtgaaaaccaacagccagcgatacttccctccctcttgtttcagagaggttggagccatcatttccatttaccaacgcagtaagaagcagatatctggaggcgacaggggagtctgcatggattgcacgttccctccaagtttatcgtctctggctgtgagctctcagtacaaattatctgatcaatggcatgagggagcaagcttggtcagtgttagagtaaggcagtgggcaagcctcacctcacagtacctgggccacaggagagaggctacctcgtgaggagcagtagaggaaatgggagctctcagtggatcttctgaagggaggagggaaatgagacctctggattctataggagtttagcattttgagaaatccacttaattttctcctgaaaggcagctatttgggggcagacagtggaaaagctggctgtgtggctgcctggtggccccagggtgacattctcacctttatcaccatggcttcccaacatcagatggcagctggggtggggagggatgagagatgggcaggaggaagaaagcgttcgctgagtaacaactgcaggacgggcagtaaacggggcaattttgagttaaatgccatcatcattccgtctttgcagatgaagtaacagaggttatgaactagctgagtatgcacaagtgatgagtaacagtgtgaaccggtgaattcctcaaggacagggattctatcatttgcagtttgtacaaccaggacctgtctgctctggtgcctggcactcagtagggactgatttaaagggggatgtggtgagatggggagcagggcgggttacatcggcttttgttgagcccctgtgaagtatcaggcagagccacccatcccttctgtgtattacctggtttaattcccaaaacatcgatcccaggtaagcattcttatccccattttataaacccacacatgcttgctaaggtcaaagtcactgctgcttaccatcgaaattggcctttttctcgctcagagggtagagtcttcctgttttgaagcgggtagggctttctccgtgtcctgtctgctcaagatgcacctcccagatgccagatctgcacgctgggcctagctttctcctttctcaactttggcctccagactatcaaaagtgataactcctcaaatctcccatgacctactgcctccctcgtcttcttttacctgcctctccccttctgagtggtcagcaggttttcttgttcctctgtgttggtgagagatgctgcagacaaagcctgcgtgtagaaagtggcactgcctatcagccttagtgataggaacacccccctgaagagctatttaaagttgaagtgatcagaggaggcggcagcccctgacactcagggattgggtgccgtgccctgttgctgactgaaggagttctgttcttttaatatttgatggggctgccttggagacatttatttaagcatgcttcattcattggagtctcctgcagaggggaagcttgcaggggaaggcaccacggcttctcagtactcagcaaaggtcaggaggggaatagctgataaattggacagctctttttagaagtgtaatctcaactgtgtgtgttttttccccttgtccacagtgaacatgggctctagccctgtcatgttactgggcctgtgctggggggagttccctacttatgcaagagacagatgaggataggagatagaggtcccggcgtggtggttcatgcctgtaatcccagcactttgggaggctgaggcaggcagatcacctgaggtcaggagttcaagacccagcctggccaacatggtgaaacctcatctctactaaaaatagagaaaaattagcctagcatggccaggcacgttggctcatgcctgtaatcccagcactttgggaggccgaggcgggcaagtcacaaggtcaggagttcaagatcagccctgccaacatagtgaaactccgcctctactaaaagtacaaaaattagctgggcatggtggcgggtgcctgtaatcccagctactcgagaggctgaggcaggagaatctcttgaacccgggaggcagaggttgcagtgagccaagattgtgccattgcactccagcctgggcgacaagagagaaactctgtctcaaaaaaaaaaaaaaaaaaagaaaagatggaagatagagcatggcagggaacatctccacactctcattgatcatgacctctccctcccagagctccaagcatcagctcactcatcatccctgtgtccttatcaagaagaccattagtgggattagtagccccatttctcttttacgcagccacagtcccacaaaggctgagtgatttatctggcagcacacagtacaggcacagtaagcctagagtaaaaatctcagctcttagaactctagtccctcgcttcaatcatggatctatgctagcatttaaaaatggaaataataagacattatcacagggctaccattgttagaaatgtctatgaacatcattaataccttgtaaggtattcgccagtgtaaattcattctctctcctccctttactttttaaatgacactctccacttcctgtcatcatggttccaacttccagatcttttgtttgctccttcctctctgttgtctgcgaattcactcagcaaccacagcctgcccattggttataccttccagtgctgacccctccggcacacagctgagggcacagcaccagctcagggcctcatggccatgtccccaccttcaaatcagtcttcctacctccacgctctttcttatccaatgtgccttatgtactgccgtaagggttaccttgcttctttctttttgtcctgcctctcctgtgttcacaagctgtgggtggctcttcattgcattcagaagaaagcacaagtatttaagcctcacatttgaagttctcaacactgtgaccttatcaaactttccaggtttccttccagcacaactttttctcaactgctactcctatccccatgcctaatttgcttgctgaccaatttaataattacctttctctggtttacctttaagaggttctgtcttgctacaattgccttttctaccttctcccttttctataattgccagtcaacattgcatctaacttgcaaagcttcagtaaatttcatctcctcgtaaatgtcctgtgatatggccactctcctccaccttgataaaatatgtctttctagaacatttccacagcaccctgcctcagttatagcactgtcattaatcgtagtcagccctagattaattaatagtagacaactttatctctttatcccccaaagaatcaggtaagcatacatgataagtccaaagcatatttgtttaaatgaattctcacctggtctcactcgctgccgttttctgctgattcccacatgccacctgaagactcagctcccatctggccactgttgttgctaagagcccaggttacctcttgcctagatgcccacaaagtagctgctttctgctttccagaaacttgaattaattcgctgctcggctgtgctaatttcactttgtctgtcacccagatgtctgtgtattgtttttgattcattgcttgaatttggatctatagcttctgctgttttactagaacatgatggaaatatctcttagctacctgttaccaaaacacatgtaaaaaatagcttcttttgttagaatatagacacttgatcacttgtttcaattcatttgagataagactggatataaacacataaagataaggatggatatacaagtataggaagtcagaccataatcaaactcatctaatcacttatgcactcgacaaatgcttacgaagctttgactgtgtgctggccagcgtgctagatgcttcccatgtgccgaaagcacagctgaaggcttccctgggcttgtaggaaagacactcttgataggttctcacaactcacaaatcgagtccatccctccttgccatcacttctggatggggaggaatttgaaatggatacgccagctgcctgaagaaataaaacattattgctgaagagggtcaaaaggcaaccctctaaacaaaaggggcaaggggttgcttaatggcatggatgtgtgtctccctttgggctggagccaggctctgctcagggcctgtgcaggcaggtggcagggagtgccatggtcgcatggggctgaatcctcacggaatccctgggaaccagccctgggaagagagcgcagtgaagcagagatgggctgctgttttttccctgtttttctagtgactgaagcattcgtcgtgaaagaaaaagggagttgtccctccttcacatgcccttcttgaagctcccttcaacgtcctctctcagaggagagaagaagatgagacacaaggaggcaggcagaccctaagtggcacctcttcacatccagacatgaaacaagaaccagacaaaacagcatgagctcaagggccatatgagccctcctccatctccacagagtagcatctcaagagccctccaccttccatctctcttacctcttcctgcctcttagaaagagcaatgtggtttataagccgattgcagctagtatcacagcaattgaatgtgtatttccgtggaagaaaataacaatggtatttattaacctagaaagataagtaggcactttctcagcagtcctggcttctagttgagaggttaaggcaggccaataaacatccctttcctcatttacccgacaaggaaaatggcatcatccgattcatgcctcctttatctcagtttgctctgaggtccagctgagatgagatatggggaagggctttgaacagtgcattagttattctaaaagatcctaagtgttctcgtaagcaacccacagattttagtgcttaatcaaaaattgttgttcctttctcacatgtcacaatactatgtgggtctgcaaggagtctgctccatgcatgcattctgggacccagacttctttcatgctgtggatctgtcacctgcagacctgatgtttctaggtcatgttggtcattccaccccatagagaatgggagaggagaggacatggcctcaccctgggatggccacgttactctcactctcattccactcagcaaagctaatgatagtgttccaccaaaatggaagggagttgtgaaggtagtttctgtgtgccttagaaggagagacagacctagtgagatctaaccagtctctcttcagtcgctgtaggctattgctcatatgtcactgacattctatcttggaaacagaggaggccagactgcttcctcctcacatccatccaacatccagctacactctggagtctgactcatctgctaaggcccctcacatggagtagatattcagtacacactggggctgtttgtgaggaacgtggtctctggagaggttggactgcaggtatccaaccacatctaaggacaagagccagcagcatggcccatgcctgggttgcacaattacaatcacattgaaagatgcatggcacaggaatatgagaaggcacttggagttctttgcccagactgtgttgtatgggcagagacctccaagtgccttctcatagtccttgcacttggggaaaaagcgtttggactttggcctgaagtcatcagaattcccatcatacaacagccatctctatgccatgctcaccctactttctcttttgcacgttccttcacacctcttatttatcaaccattcagtgtgtcagtggaaataggcagctcatgcacttttattcagcaaaaagcatgagaacctactgtgtgctatgtactgccaggactacccatgtgagtaaaatgaaagcccagtcctcattggcctgatagtctagggattaaaataatagacagtagttagtatttgtagtttgtattgagtaagcaattctgataaaagtgcaaaatagatcaggggaagttaaagaaattataaccagggatatcagtgcaatgtcttgagcagagtttaggctccagtgtgaagctgggaagactttcaaacagcaagagtgacatggacataggtcttgggagcaatagaacaatcattctgaccagagtgggataaagacagtcaggccactggggaacatgttgagaagaacattgagtgccaagctacagacttttgaatttatttattaatgagttgcgacccttttttggttttggatcagtgaagcatattgtcagaacaatacattttaaaaagtgttctgctggtagaagacatggtggattgaaatagaggtgagaatagaggaaagtaaataatattaataagtactacttattgagaattaacacacaaccaactaatcatatcaactactctgtgatgtatgtgctattattatttaatagagctcttaaaagtcagagcttgggctctaacccagcaaactcatgccctaaaagccaaggaacttggcatagtaatgaggacagcttgaaagtcagggtggaggtaatgagaatgaaaggaaagatggatgagacagagcgtgagaaggaagaatggatcagatttgttgatagattgaaattaggggatagtgaaggtggaaatattaatcctcattattatcctggatggttaaatagtattgttaaggaaattagggggaaacatttgagtgggaagggaaaggtaattttagcttcagatatgctggttgaagctatgttgacagctcagtgcaataacttatgctgtccctggagagaaagcagggattcttgctgggagcagccaggtgaaggtcccaggaggcaggagaaaggtgagattcaataaagatatgggaagcatctgtgtgaaagcgacagttatgaactgccgtcatctgtaggtaatgaaggagagagagagacaggctgaagacagatagagataagggttgagaagagtgggaaaaggctagggctgccctggtcaggagaggacttgaggaacccaaaaaagatgaagactattttgtggagcaaaatttgaagacttgttgaaaccagttctgtatgcacagttgatacaaaccaaagggagagggagagcaagccaaagagagagaaaaaacaatgtgtgaactccaggagggctggatctggaaacaagagtaaggatgtcagtggagaaatgggtgaggcctcatgcgagagcccggcttggaatggagaccacgtgcctgcaccatgctgccttgttcctctccttcacctgctgcagcagtggtcatttcactccaggaggcaatctcaagtccacacactttggcattcagctgcttcttcttctccttcttcttcttcttcttcttcttcttcttcttcttcttcttcttcgtcgtcgtcgtcgtcgtcgtcgtcgtcgtcgtcgtcgtcgtcgtcgtcgtcttcttcttcttcttcttcttcttcttcttcttcttcttcttcttcttcgtcgtcttcttcttcttcgtcgtcgtcgtcttcttcttcttcgtcgtcgtcgtcttcgtcgtcgtcgtcgtcttcttcgtcgtcgtcgtcttcttcgtcgtcgtcgtcgtcttcttcgtcgtcgtcttcttcttcgtcgtcgtcttcttcttcttcttcttcgtcgtcttcttcttcttcttcttcgtcgtcttcttcttcctcgtcgtcgtcgtcgtcgtcgtcttccgtcttcgtcttccgtcttcttcttccgtcttccatctttcttctttcttcttttcttcttttcttcctcttcctcttcctcctcttcctcctcttcctcttcctcttcttctctttcttctttcttctttcttttttcttctttcttcttcttcttcttcttcttcttcttcttcttcttcttcttcttattattattattattattttgagacagagtctcttgtcacccaggctggagtgcagtggtgcaatctcggctcactgcaacctctgcctcccagattcaagcgattcttctgcctcagcctcccaagtagctgggattacaggtgcccgctgccacaccctgctaatttttgtattttttttagtagagatggcatttcaccacattggctaggctggtcttgaactcctgacctcaggtgatctgcccgcctcagcctcccaaagtgctgggattacaggcgtaagccaccgcgtccagcctatcagtattattattattattattattattattattattattgagacggagtctcactctgtcgcccaggctgtagtgcagtggtgcgatctcggctcactgcaacctctgcctcccgggttcaagtgattctcctgcttcagcctccccagtagctgggactacaggtgtgcgccactacgcctagcaaatttttgtatttttagttgagatggggtttcaccatatagaccaggctggtctcgaactcctgacctcaggtgattcgcccatcttggcctcccaaagtgctaggattacaggagtgagccaccgcgcctggcctcaactctattttttcctgcttttcctcttctcgttaagactccctagtcacctcaggaaaattacatttgttctcttttatttccatttgtgaggggaaaatataaaagtctaatcatgactgatccgaatgggaagtgctggagtcatatgcctactggagaaaaactcaagccccgcattcatatgtaaaattagacatggcccaacaaaggtgatattccctgttcccatagctcctaaatcatcagccactcccactaaagaatatcagtccaatctgcctcatttcttctaattactccttcccatttctaagtgtcagaaccccaataaaaacaaagcaatttatttagatctaaatattcaataaatgtatccttagtgctttctctggaacagcagatgatctgaaggcaggcagattggattcaaattccagtttcaccacttattaactatttagcactgggcaacctctctgagtctcggttttttcacctgtaaagtggggatagtaatagagcttacaggaaggttaatgtgaggattacattaattaagatatgtaaacacttagaatggtttctggtgcacagtaagccctgtaaaagtgctagcaacgattattgttttgctgtgcaaagaggtatttaatgtagtttctaccctcagtgaactcatagaagggaggctgatttatatagttcaattgttctcacattttgcttaattattagtgtagcagcaccataataagtgcatttcagtcacattacgtgttagattacttttgtgggctcgtggaggcaccctgacaatcatttatggcatatctggaaaaatgtatgctaagctccatatagtcaacaaatactttgaaatacactctgttctaatttgggaaacttaacttgtacttagtattttagtattctaagtctgttcattcagctgggtaggaggttcatgtcaatgaaagaccctctttctaggtttatgaatggagaatagacttgctgatcattcaagcattccgggcaatgcttaggagctcagtaaaggcaggttcattatgtaggcatctctatgaatgcctactcttggagaagacctgagtgagaccatctgagggtcttagagagggttcgctctaagacgcagctttggaaccagtaaaatctacagcatctaccaggagtggggtgggagatgttcccttcatctgtgggaggagggccttccttttaggcataaatgggatttggtagtccaagaggataatgggaatggctatggaaggcatgttcattaccatggatttacaaacaggaaattaagcagattgtcctattttcaggtgaagaaacttgattttgagaggttaggaaatttgctccaaatcagaggtagatactggctgtctagccaccatagaggagatctatatatggaggaggagggcaataggtttctacgtatgctcctttccccatatggttaccttgattgaacagaggtaccccttgtcttaatccgtttagtgttgctgtaacagattagctgaggctgggaaatttaaaagcaaaagacgtttagcccacaattctggcggctggaaagtccaagaatatggcactggcatctgtttggcttctggtgaaggtcatacactgcgtcaagacatggcagagaagcagagtagtgagtgggtgtgtgcaaagagaccaaacatggggaggaaccacccactctttctggaactaattcagtcccatgagagtgagaactcgctttcaagaaagcattaatctattcatgaggaatccacccccaggacccaaacacctcccaccgggccccactttccaacactgccacattgggaatcaaattttaacctgagtgttgatgggggtaaagcacattcaaaccatagcagctaccttcctaaaagaactcttgaaaaaggaacctgtattttagcttcttggtgcatgtaatttgctgtttgcaaacctctctagactgttcacactttcactggatgtcgatttttcctgacatgcttaagagctcctgatgttgctaggaagtgcaatttgctgctaaagtgtgaaacttctccctaaatggaaaggggaggaatatgaaacaatgacaacctttaggttctttttcccaggaaggacataaaatgttaacttgaattgagcctccctcttgatcaggaccttggcctgtctcaggcgaccttgatattcaaagtgggtttataggagcagaataacatgatgatacaccaaactcaattttatggatcctaaagatatcagaagcaatatggccagcatgatattgactcttactgaagtacctaatgcatgagagatatctggaactccttgacattccttctgtgctatgagtcagtcctctatttaaaacaagcaaacagacacatggcaagtaatatcaacatctttagaagaaaagtgttgtatccacattgtttctctctgtgcctaagtaaaaccgcagaaaagtaaaaatctccattttaagtagagttaaaatataaataagcaaatataagaacaggatttacacacaaatctccaaagatcattcaccagccttccaaaagagtgaatgcaggagtaaggcagaatagttgttcacttgaaatcattaataaaaacacacacttagaagagtttttcaagagaggctcagccaaatgctctgtaaaaatgccccccacttcccagaacctttccacaagtacccagagcttcctgttgttaaataggagctaaaccagcgatgagaaaaccatccttcacgttaatggtccttttggcctttttcttcctgcaaatatgcaaattcttttgagggcatccgtcataaccattttttcaaaataatttattttttaaggtagacttctgatgaccattcctttctatagaaaaataatattccctaaaatacccccatgaaacacattaaaaccccttccccaacacacacacacacacacacacacacacacacacacacacacacacacgtgcacatagaaactgcagtggtatttccttaactaacaaagcccaacattttaggttcttcgaaatcgagccacatcctaaatttccaatcttacttccaatgtagcatttcttgctccacctgctcactcccgtattctctctctctttccctctctctattccccaccctttctccttttccctattctctcagtctttccagcctgaatgcctgattccaggagcgcctcttcctggaatgcccttcctcccacctctgcctcttgtaagccaacccagcccattaggaagcagctctatttttagtgttagatgcttccaagacactttctgctcctggtgtgctacaaaggcttcagtattgatctggaagctgctttctggagccttgatcccagtctgtctctgcagtgcttgcaaactccatcttctagaaagtggggaaaaaagttggggctctgcactaaaagctccttctgctttgtttgagggtgggtttgagtttggcagcagaggcatagacaccacagtcaaaagctttattcccactcttccattgctgtatttctcttcatgcatatcattccaaactcttactcctctatcttgactcataagagcccttcttcacaaatagaaacctaaatgggttttactgtatgcattattaatttttcttaggtgtctcctactctcagtctcaaacactacatccctgagcatctgcaaatgccagtaatgagtttctcatagtaaatagctagattcttaggtcttttgaataaatatgggtgaagaacgaactatcagaatgagtctgtgaagggtaatatggtatttcttggtcaatattgcttttttgtcccacagtggagttctgccgctgttacatatggcaactttccaacttgggtaattacattctgcttacctcttgtttctcttgtggttccaagataacttatccttcatgtcctttcctaaataaaataaagaagcctacttttggttccgctatttgcggagacaactgaggtagagagaggtagcagagtggaaaaaggacgctactttgaggatcctgcacatagacactccaacgcattctagtgggaatgttaactccatagagcctcagtcttcgcatctgtattttgggagtcttctgccctactctaaattgttatggagattacacagaatattacaatgaaaaggacttttaaaagtactataaatatctatgggagattgttggtcgcccacacagaaaattcaactgggtagggacaggtttagcagagcatttcctaagagaggaaaccctcctatctcaaaaacaaaacccagtctgtcccaacagttaaaaaaaaaaaaaaaaaaacctatggagggcaaagaataggaatcaacacacccacctcttgcacaggaaagaggcaaagctgttgaaggagaaacaggacagaaacaggagtcaaagggtgtgattctggtagaacctcaacagttaactagccaatcacatgctaatcataaggctagtgtgccgtcttaaattcctcagtaacaggcagggatcactaacgcttcagctgttatttattgttatgaatattgttgtgaagatcacaagagataatataccatcaaatgagaggcccatgcgttgttaattaaccaaactggagtgccagccaaagcaagatatgctaaccagggagaaaaatgcctttcagagcagtttttccagaaatttccttttagtgattgtacaattcagtgctcttgattctaaaatgaatatgaggctgttttcaagaaagaaagggaatcagtgtgtgtaaaatgtgcactagaacaatatccaggaaatgaagaggaggagagtctgggaatggaaaaaatactccagaaaatacaagtaaaagaaagtggctgtaattatgcacaacagctctgagccaaggaaccttactggtgtttcctgctgccttgtagctggggtgcagggagctctctgcgccctcctggcatgaatgactttgggtgcagggagaacagcaccacctggtggtcgtagcaggatggtggctcatctcgcttgatgtgggctgggctcctttgcagggttcacgcaagagttcccttggagcaaggaagacagcggacaagacctggagcaagtcgaggatatttcaggaggagagcccatggccgaggcgacgcagcaggaagagagggccaagagtcatcccccaaggggtgactgcccagttcccctttctctcctgcctccactgccctggaaacaagagcacaggggccatatgcagctcactcacccacctaagactctgaggaaggcctttccgaagaaatggaaggactgtggctcaggacagaggtgcctcagtccctgggacttccagtgtttgggaggaaagaccttgcaccactgaagaactcccttctattattctatgtggatttcattttgtagatgctcaaatcactcggagcacctttccctagttaagtctgcaagtggggaagtgaagcaggttttgtggtgctggtcatgtgagcaggaaaggggcatgggatggaaggcctgggaatgtcttattaatagttaagtggacaaggctgataatgggatatctttttattggccccacaggtaagttataatacacaagcttgcaggcagctcctgtgatttgcattgatacaattcaggctgaggttttcattatgtggcagggatgatacaggagcctgtattatcaaaggcagctgaaaggagttcaggagcgatctcatattctgtgtatgcgtattcattaatggttagtaaggtgctttgtcccgtgtgatattggatgtttcatgttgaatcattaacaacttgaacagctttatacatatgtcttattgatgtgtaaagtcattgcaacctaggctttttcccccccgaatgaatgagttctgctttacttgggcttatgcaaaaagcctagtgacattttcactgagcacaggcaactcgtggatgggaaaggggctggcaaggcaaaccccaggaagctggcagtctggtgtaagagacacagggatggttggtttttaaagaaacagcatggcagcaggggatgttattaatcaaagggagggtggattctgtagttgctgctcaagggaaagagaggggagctactacacttcctgggggatggcataagggacacgttttccgagggtgatcaggggttcttctggaaaggggatggggagaacgggctgcctgtgttgcccagggggcaaggagaggagagtaaatgatgagcagcccgaaggtgagggaagggctgcatgaggtaggcaagagaagatgccagaagatggaagaaacgaaaatgtttagcagctgacagtaagaaaatgtggaggctaaaaacaaaggagccaaggcagcttttcctggctggagatgggaagaataaatgggatcagagttagaaaccaattatctctgattgcacaatcaggacactgcttccgaaccagactccagccgccctgccacccaggggcctgaggccacctaaggatgatgtcagatctcaggaactgttgcatctgattccacttcagccctgattatcattaggcaacatttggaggccatgccttctgagtcctaacaaagcagagaattttcaggctgtgtgggacctactttgcaggcagaattttaatttctgagttattagacaccaaacaacctgaaataagctttctggtttctctgacgttggttctaagccctcacagagcttcctgaaaagttcaggacttcatgccagccctaacgccactggccagtctaccgaccacccatctccatatctttgggccctgagtatctttgtggactttgtcccccaagtttttttttttttttgcttccctttgtgatcccaggaaaatactgatcgcttctatcacagtggatgagttgcattttctattttttgtgtaaatagaattatagagaatgtactcttgttttttctggctccttttcactcaacgtaagtattttgagattcagccaaatgtgtgtatcaatatgtcctttcttttcattgctgattagtattccattgtatcggtgcaccacagtttggttggccattcagctgttggtcaacatttgggatgctaccaatttgcagctatcataaagttgatatgaatattagcgtataccttcatttatcttgggtacatgcctaaaagaggaatggctggctcatataataggtgtgcttcactcttcaagaaactgtcacactattttccaaagtagttgtatcattttacattctgaccagcagtgtatgagaggacagagtcctccatatcctcaccagcaccaggtataatcagtctttttaattgtagctgtttgaatagtgttgtagtggcttgtcattgcagtcttaatttgcatttccctgataactcacgatgtcaggcatctgttcatgggcttattatccagtggtgtatcttctttggtgaagtgtttttcaaatcatctgccaatgttttaattgggctggtatttcttagcgttaaattatgagagtttctgtgtattctgtctacaagttctttattagctgtatgatttgaaaacactttcagtggtatttgtcttttagttttctatacaatgtctttcaaaaaaatttttaattttgatgaagtccaactgtcactttgttgttttatgaaagtttctaaaagttttacagcgttatattttacatataggtccataatccattttaagttaatttttgtatatggtataaaatatggattgaagtccattattttgcatatggatatgcaatttttccagcaccatttgtttaaaggactattttttctccactgaattgctttaacacatttgtcaaaaaccagttgtccatataaagacaaaaagaacatacaattagacatctgggctctgtgaggttcaaacatgttaagacagcacttgaaattttaggtcttaaatatatgcaaacattcatgggcaggtttttatgtggacataagtatttaactcatttaggtaaatacctaagggtgttattgctatatcatagagtaagcctatgtttaactttgtaagaaactgcacactgtcttcaaaattgtctgcatcattttacatttccaccagcaatgattgagagttcctgttgcttcacatccttgtcaacatttggggttgtcactatttttaattgtagtaaattttaatggtctgtagtgggagatcatagttgttttaacttgtcattctctgatgacatatgatgttgaactttttaaaataattttctcctatgttatactctagaagttgtgctgttttgctttttacatttaaatttatggtccattttgatttaattttggggaaagacgtaaggtctgtgacttacatcattttggctgctgtaaaaacatactatagtctgggtagattataaacaactgtaggaaatagacatttatttcctacagttctggagtatgggaagtccaagatcaaaacacacatttagtgtctgctgaaagcctgcttcctggttcacagacagccatcttttgctctgtccttgcatggtgggaggtacaaaagccctctctagggtcccttgtgtaaggacactaatcccgttcatgaggcctttgctctcatgacctattccccaccccaaattcccacctccaaatatcatcacactgggaattaggtttcaacatagatattttggcagaggcagtgagggagtgacattaatattcagcctacagtggtctatgtctagattcattttttttttgcatgtggatattgaattattccagcactatttgttgaaaagcctatctgttcttaattaaatttctttagctcctttgtcaaaatttagttgactatgtttgtgtggatctatttccaagccccctgtgctgttacattgatccgtttgtctgttccttcgctaataacacactgtctggatcactgtagctttgtatgtcttgaatttggatagtaccagttctcttactttgttcttctttaatattgtattggttatttgggggtctttgtgtttccattaaagaatttagagtcttaagtcatcatagtaatgttttaataatattgtctttctatctatgaacacgaaatatcaatttatttaggtctttgatttcttttatcagaatttgtagtttttctcaaatagatcttgtgcatattatgttagatttatatctaagtatttcaatattttggtgctaatgtaaatgaaaaaaatgtttggccaatatttctaaaaacattttttatgttcctttctcctttcctatagcaactcaatttacatgtatatttggcctcttgaagttatctcacagatcattaatgttccacacattttcttttatcatatattttcttctatgcttcattttcagtagtttttattgttgtgtatttgagttcagtattttcttcttcattgtctaatctgtcattattcttatctagtattttctttatctcacacattgtagctttttatttctggaagtatggcttagatgattgtttgctcatttttcatgtctctgcttaactatttgaacgtatggaatacagttataataactgttttagtatccttggttactaattctaatatctatacataatttgtgtcaattcttgctttttttaattgactgattttttcaatatgaatcatattttactgcttctttatttttatttatgtatttattttattttagagataagttcttgctttgtcattctgactggagtgcaatagtgtgatcatggctcacaacagcctcaaactcctgtgttcaagttaccttcctgcttcagcctcccaagtagctgaggctacaggcatgtgccatgacacacacagctttttattattattattgttgtagagatgggttcttgctatgttgcccaggttggtctcacactcctggcctcaagcagtcctcccacctcagcctctcaaaatgctggaattataagtgtgagacaccacacccagtccttgcttctttacatgcctgatactttttaaactaaatgccaggcatggggaattgtatcttgttgtgcacaagatatttctatttttctataagtattattgacctttgtcctgggatacatttgaattacaagaaaataatttcatccatttgggttttgcctctgaaatgtgttaggcagaacttaggactaatccctccttactgaaaatctttcggtgtactctacccaatatccggtgcattacacggctttcctgcgtggtggctaggagcaagcactcttcttggccctgtgtgctgctactactaaccctctcccctgccttgggtagttcccttacgtgcatggtctgatctgtactcaactgagtacttgggaggagttctttgtagatctctgaagctctctctctgtgtagctaactctctcctctctagcactccattctggaaactccagctgctttgatctcccccagactctcaacttcatctcttcaactcagagagtctttcagttcccacctgtttccccttcccctgtgtaaactcttaaggcaatgagttgtcacaactgtgggtttactttgttttccagctctcgcggacctctgtctcatcacctgatgttcagggcctcgaagatgattgctgtagatattctgtgtgtttttttattgtttcaggtaggagggcaaaactggtccctgttactgcactttggccagaagcagaagcccgggctacagagagggcttcctggggtcctcatgagagcttcattttgactggcatttcttctccactctcttggtcacagtaacagctctccctctcctggtgtcaatgaaaagctcgttgtaaagatgcagcttttctcaggagcaacactgacaggcctgggaatctgtatcttttccaccctggagttcacagtcagtagacaaagagctcccatccatgagaaggctgcttacgccaagctatggcatctgaggctccttcggagactcacgcttcttctgagatacctccaggggtcctctccactggcagggactacaccgtttgaaagtctgagccatgccctacacatgagggagaagttcattttgtggagtggagaacttggctcagggagtggtacagaaaagtggattccaaaaggaataaaaggaagccctttctggagattattccccttccattttttcatccctcctactttttacattcgaaatggaaggggaggctgagaaagctatttgccagctccttcagactgactctgcaaggcaggcattaggacaactgtcagaagagcaatgaatctggattccacctccataggggtatttgaggaatcccttgggcatgaggggacggggctgccaatgcatttggcactcttcattagttcctttattccatcagttttcagtatgcctccactctcagcagtcactgtgaggtgctggagaccaatgggtgaggaaacctgcggtaaagagtatcaggactaaggacagcaaggaggggagctgaagatcacataagggattcctgaaaaaactcaagggaaaacagtcatgctgtggtgatgtggactgatgggtgcctgaaccgcaggaccagcctatcttaaaaaccacattgtcttccatatgcggaacaaagcgcataatcatcccgtcttctgctggccaaccagacccgtcactcagagccccgtttggaagcctgtgttatcatttatctcttatgtccatatgaggtgcccctccttgatgcttgcatagtcccttatattccccttttagaaaaatacattttagtgtttttctttttttcttcttaattagatgataaattgtgatgacagcaatttgttttgttcacatttatatccctagtagcacaagcctgtgcacattgtagataattagtaaatatttattagataaatgacttttttttttttttgagacagagcctctctctgtcacccaggctggaatgcggtggtgcagtctcagcccactgcatcctccacctcccgggctcaagtgatcctcccacctcagcctcctgagtagctgggactacagacatgcatcaccatgcctggctaatttttgtattttttgtagagacagggtttttccaggttgccgggctgatcttgaactactgggctcaagcgatgctcctgcttcagcctcccgagtagctgggagatgaccagcatgagcttccatgcccggccaagataaatgactttggactcattttctccttcaaatgaccctaagagatactcagaggacctataattatcatcatttgacagatatacaaaggagacccaaaatggttggctcttgaaactttagaataatagtactttaaattaccagggatctagaagaatatccactgcaggacatggcaaagccatttaagcctagaagtacaagatgatggatcaaaagagggaaaggggcagatctaaggacagcttcttgttacctttcctaggtttacagatactctcattatattttgaaagtttggagatgggaaaaaggaggtagtgtcaatagagctggccatgcagtgaaaatgtggatgccatctaaagtaccatcccaccacttctctgccagaatgctgaattaaaaagaaccatatctctccctacctgcccctcttccaggcactctctttttcagtgatgacatgcaccttttccattgctacccctttgtcaagctcctgcatgtgcccgtgggtccctatggcttcgaatcccaggagggagctggaattccaggcccagtatctttgtgtagctgggtagccttgggcaagttactcaatcacttcattgttctcccagaaagaattttaaaatatggacttgaaagatacacatcaatagtggctgcttatatgggattgggcagaaggagtcaaaagagacttaaagtgtatctgtaagatttttatccattctttaataatgtctaaagtaaaagtgacagaatgtaacacattacatttagatgatgggcacatatgcatttgtccattgtcctctgtgcttttctgtgcgctgtttgtgatgattaattttatgtgtcaattcaacgaagctaaaagatgccagatagctggtgacacattatttctgggtgtgtctgggaaggtgtttctggaagagatgagcgctgaaactgacaggctgaattcagatcaccctcacagtgtgcgtgggcatcatccagtccatcgagggcctgagtggaacacaaagacagaggaagggaaaatgtgcttctgtttgagctgagacatcgccttctccagacctggaaccttaatgctcctgattcttgggccttcagactcagactgatttataccactggctttcctgcttttctggttctccaacagaacgtggcacttttcaacctctatgtgagccgatttctataatctctctctctctcatatatgtgtgtgtgtgtgtgtgtgtgtgtatggtacatatatatacatgtgtatatgtagtatatatatagtgtatatatacacatatgtgtctatacatgtatatatacgtgtgtctatatatacatgtatatatatacactatatacatgtgtctatatatacatgtgtatatactatatacgtgtgtctatatatacatgtgtatatactatatacatgtgtctatatatacatgtgtatatactatatacatgtgtctatatatacatgtgtatatactatatacatgtgtctatatatacatgtatatatactatatacatgtgtctatatatacatgtatatatatactatatatatactatatatactatatacatatatatacactatatatatactatatatactatatacatatactatactatatacatgtatatatagacacatgtatatatactatatactagatactacatatagtgtatatatacacactatatatatacatgtgtctatattttttatatatatatatatcctattagttttatttctctggagaacactaatacacagttcacatacaaccattaggggagggattatagaatgatgatataaatatcttgcaggctttggtgaaaagtagtgattctgtatgtaaaacatgaatacgtagctgatgcagtaagtgctagaatgtttgcagcattggtggggtagagaggaagagaaaaagagatagaggctgaattacaaagagttctggtaggtaaagctcaaacatagacactgggaatggctttgattaattaaccacaactgaatccagggaagggatgttttcacttagggaaaatggatgcaagtctatataataaagtgacctcctcaacttcctggggtagtttaaataccctctctacacatccaaagcattgagaaaggagctacctcccgacgttgcttcttagaaccaggattgtagccaatcagtatatctccagtgattacaatcgccattccaaacggttgcctggacaatggggagcttaggccattggggctttttgtccttatttgtatgaattcccaacccatatggggtttaagcagagacaactgcccaatatgtccaagtacacacaggaaagaagtgactcctcattgggtgtccactgggaagacctctcttccttaggtctctccattctcttgcaagtagaaagaaattgaatggaaagattattcaggttcctacactggttttgaacaaactactggcaaagttattgaacaaggagactatgaggaaaatgatgggagggcggaggtgaggaaaatattttgaggatccaaatcagatgggttctgcaagggtgcatgagcctttcagggttgcagaacgtgatgaaggctgaggaacaaggggcctgaagataacagctcagtctcaatgcccccatactgtctgctgggctctgcagtggggctctgtgattggaacggacacctttgccctctggtgatgctcagcaaatgtcaggctttaatgagatttttcacactgttgagggacccttgtgaagtgtgtgccactcatagcaagtcaccagttgaggttgcattgacttatctctctggggaggggccactgaatctgtgatgtagcagacaagccataaagatgggtctagggtgccctgggcagaggagatgtcctgataccaggctgctgtggttggctgcatcctaatgaatttgctgagagctttgcaaagagcccccgaaatgggggaaccctagggctgagagacaactgtaaatgtcagactgcttaaccttcaccttcagggaaagctggacttaagagaatcagagaataaattcactttcttaaaatgcctttttttttttctaaatttcctgagggtatggcttaagtatgggagaagtagactaatcccccctctcatttgcactcttctcttacatttccttctctccattgggtacccacctgcaaagcatagataacaccattttctgtgcctttaaggtgtggtagtcattgctggcattcatgttgaaggatagtgacaaaactgacagtctttgacccgactcatgctgccaacttcttgggggtggctctgcttttgtctggcacagagaccgctcagtatatcccacttcctccttctggttttattttctgaaacctcagatgacatggaacgttgataccaacgataccagcacttaggataattataataatgaattaattaaaaccccataaccccttaaagcaccagggtgctgaatccgaatgaacaaccacagagagagacccaggaaggatgccactcaggaggcggtgaccttttggcatatggttattcaggggttgggtgcatgggtttttaaagaactctccaagaacccatccatctggacccctgtgttgctcctccaagcatgccgggctgaccagatggccctggataaaacagcttcaggggagggaggtggggaacccgtccagaatagcttgtcaccctcggaggcgtgctgcccttggctcaggcacatcccttgtttaaatcttaaaagcaaagattttgtaaaatgtgtttatgggttgtcatttccaccagggcaaacaataaaaagactacccagcaaatacgcatctaaataaaacacaaacagactttgataaacaacaatatggtccctagcatgagaatttcttcacccagggtctctgtttaatattcatgatcttttcaaaatcttttaaagtctgagaaatacaagggtagcacaagggcaagaatcatctgtcacccaaatgagctggctgatcccaaaccatataatcaataaagtgtctggaattgagggaatttcttactgcatgatgtcataggagaaaattctccttcaaatccatgtccttggggttgtcacagtgtatgcactgctctgagagggaattgattctgcagattgaaatattttttccaagtcactttgtaggaaaaagtcatggaaaaacattatttctgctttcagaaggctctgagagaattttagaatatctatctttgcagtattttagaagcacattgctagtgatttccaaatgaaaagggaatgtgaataccttataatgctgaaagcagctggagaatagaattactcgctggctgtagggccaaatgccatagcagtgtcagcgaacttttgctaagcctttattgagagagatgctagattccagtttacctgggacagcaggtatgttgaattttctagttgaggtggatttgggagatgaatgtcagcatcatctggaaattaacaagtggctagctaggtaaatcaacgctgagttgtgctggagagaagaggaaaggtatagggaggggaagtatattttgacaaaaaggtgcccaggtggctctcacacactctccatgctccccacctccgctcctcatgaagaaccactgtcagaccatgtgcatgtgctggaatgtgagaaatctaagcacccaggaggatgtgagaaccgtcaaccagaaatcagaggcctcctgcccagaagtgcctgacaacttccatgctcacgttttggaactagagatctgactcagcaattctaggtctgttactagccagcaggatgacactgcaaaccccatttttcttggagaagactttaccctaccactcttactatggattaaaaacaggaagtcccaagaagattagccactgctcccccaagactatcccaaggttgggcaaccagcagcagctgagctggaactagaattcaagaatcccaagctccgtccatgtctatatgattaccaccatgcatgctcttttcagaaacacagtgcagtagacaaggacaactacccatattcgactagtgttatctctactattaccaggaacaacaattttacactattcctaagttgctttctcaaatgttatatggatatatatgagaatatgggagccttgaaaatatgggttttcaataagcatttgaccaggccctacatcaatatgcttcaaataatcataagaagatggcatgaatattttgtaacttttaagggccaaaaataaggcgtaattataaatgatcactttcctggggacagaaatgttaacattagaagtcgcttggggcattgtttctgaaaccacttgtcaaatagaagacgttttgtaatctcaaatattttagaaggtcttaaggattgtcaagaaatgaaatggtattcatctggaaaacatgctggcagatttcaagagccttaaatgggtaggcatgaaacaaatgaactttagtgttatcaagtgtaaattaaaatatttatgagaatgtaatctaattagatacaaactgtttccccagatctcaccagcctggggagtaaaaatgagattgtgtgaatagtaataaacagatgtagcagtctctaactcctccatgttgaccctcggcccaggattcctatcacccccttctaatctgtgtcaagagctcatgctttggccagtctactataatcacatacatcccagttttcccagctgggacttgtctgaagtgtatcaggacattccgaggatatcttttatctatcgtaacgaatacctattcttggcaggcattcactaaggagataggtgagtaaataacataggttttgatgactgacagagtagaaatttctagaaagtttctgccagacagaggaagtgactctgtgcagttatagattaattgaaatgctatggtttgctaggtaaatcccatagctaaatgaatatgatggaggccaagaacagtggctcatgcctgtaatctcagcactttgggcgcccaaggtgggctgatcagttcaggtcaggagtttgagaccatcctggccaacatgaaacccgtctctagtaaaaatataaaaattagccagacatggtgacacgcacctgtagtcccagctacttgggaggctaaggcatgagaatcgcttgaacccaggaagcagaggttgcggtgagctgagatcacaccactgtaccccagcctgggcgacagagcaagattccgtctaaaaaaagaattaatatgatggggtgtttagtgaattaccgtaagtaagtagaattgtgggtgactatcagaactgatggtgttcagtatcttcctggccattggaagctctggtcctgaaaacagatcatctctcaccagctgggaaaacttctgagatgtatgtgatcatagtagactggccaaagcatgaactcttgacacatcagaattactgagtgatgttcacaaaactaacccctccaaactgatttcattcattcaagaacagaatcacttacttaaaagcacagtcactgaagccaggtctcctgagttcaattattgactatgatttcctaggtggtggtcttgggtgactgcctcaacatagctgcacttcagctagcatgtgccctggaggcagccatgcctgctgtctagagtggttgagagaatcctatcagttgattcataaaaaatgcttgaagctgtgtctggcatggggtaagtgctcgggaaagcttagctcttgtatgtttccaagtggattttaaactccatgagggcaatgctgctgctgtaaccctagttcctatggccttgcccattttagctgctttgtaagtatttgtttattaactgactcgtctttgaaatggaaatgatatttatacacattagatgcaaactgctttgctcagtaaatgtgtgtgcgtgtgtgtatgtgtgtttgtatgtatacacacaaatatatatgttagaatatgtatacacacatatacatgtatatatgccaatagataagaagctattctctggggacccagaggctgagaggctcactgtagacctcagctcttaacctgaacttttatgggtagtggtgaagcaggactggtgattctgctgtctttgagtttcaggcttccagatcaggcccaaagcagtgaacaggcataaaaagatggacctagagctttcatttcctttgactccacacaattctgcactggcaggaagagcctgcatctgccccacagcatcacccctctctccctgcagccctacctgccctttcccgctcacctttcccgctacctgctccaccgcccacttcactcccacgtgcatcctgtgcgacgtgaacatggaactcagtcttccccatcctgacttcacgtgagcctctgcccctgtcttctctgactggtgaacttctcattactcacgattcagttcagtcatctcctttgtgaagttttcctcgcctcccctcctcaggctgaattttacactttgaaattgtcccgcaagactctgtttataccttgttgatatgccctatgctgtttgcactatgtcaggtgaatggtttctcccctctgctgaaatcggagggttttgtttatattcaagtatgttactaattcccagtgccctgggctgggctgcgtaccaagaagcgcttggtaacctttggatgaagggacccaggagtgggtagatggttgcattcctagtcctactgtctaattatggcattcctaactgatatggctccaggttcattcaaatcagggacagaaggcccttctgaaatagtagaattccaaatgtatatttgaaaagatatagatattatatactagatacatctatacagatacatagataagtgatatagataatttggcccctgagcaaaggaccatgagaatctgaggaggagctgtgcctgagccctctcagcctcttctctgggagtctcctggccagtatgtttgtctcaggcttggctggagggatgggccatttatagagcctggggcacgatggctgtagaagttgcctgagttgatgctgataaaaaacttgccaagcgctggcatgatgtgctatttatatgcacagttggcctctaaaaaagtgattatccaaaggaagtaattgtttagagcctcacacagaaagccagtcctcctttggccttcgggactaacattgctaatcagtgccaaattactgctattttaatacttgaattaaaaacaagaccagccatttgcttggtggagggtctccactggatcacgtccatgtgtgggtctgtgcaggagggcactttgctgtgttcctggctgccagagagcactttattgggagagggaggcatggccaggaatacttagctgtcagccagcttcctgcctccgccacctcaaggaagaactgcagagctgcttgcagggtgagtgggagttctgtgctactgagcgggagtgaactggggacaagacttttttttttttcatatggtaaaaatccactccatgtgagaagagagcatcttgtgaaggcagatggccatacatgcggcctctaggaggactcttcaccacctctcagcccccttgacttccatgtctccatgagtcttgctactgagcaattctctccatcctgtctccttgaccaaatggaggcattcagtctcctttccagttttcagtccactttaatcaggaccattgtgtaaactccatgaaaggaaggccagccctgacacagagaaagactccagtttataactctcaccgttaaacaaccggcatgtccttgcaccagcctgggccctgaactctcaaaagacagaattttcttcatagaggcctccctacagctcatatgatgtgaacaaagcccaggacagacatatatcccagctatgtcagtagagagtcccagaaagaacagggcctcctacacatggaaacaggcactgcactaccacttttagagacatattcaaaagtagttcctgcagtccagaagtttcacctgagtcacagtttgctaatcagggagagctgagactcagactgcggcatgtttctttctgaagagtgtttcacctgctggggaaacttcacacccctgtagactcaggttgaaaacaaaagctgctatttgatgtctcctccacttgcagttccccaaggatgggggaacttggacagcccccattcccttctggaaacatctttttgaatattatttgaagacttcatttgataaagtgctgcaaaactttccagtgatacttttagaatcagttattattggtattattgtaattattccagagttagagcttagtttgcttctgatctaagcactttctcttgcttagtattccattgcaattgtacattactttcattttcatttcctacagttgataatactttttttattttgagagtgattaccaaactggtcactctgagcccaagggcaagtgaaattatctcgaatgtgctcccacagtaggtttaaaatcaggctctcacatgaccaattcagctaggtaaatacttctcatatgagcataacatcgaaaaactacctatgtcagaaataggtatatggtgggaaagagagagtgagagaaagagagggagaattgggcatctgcgatggggcccaattcgctttggtcccttcacagctcagtgctagtctatgggaacaccttaggaccatggttataagaaggccccgaaagctctggtccatcacaggttctcctcaagggcaatgagaacacctaaatgttcaagctgtgagataaatgaggaagaaaagaagtatataagctattcagtagcaacacaaactccttgctgaaatggatggatctagggtctgcaggatgaacctagaacatcttcatggtccacaaaataaagaagtgctcacaaaaccatcagaacatttgaaatgacacaggagccaacttgaagggactcccattaaccaaatctgggataatttgagtattaaaaatttttttaaatggtttttaacagactgtaacaaaaatagcagatgttaatccattgagtagaataaaattaatgagttgtatggaattaaatagataacagaataagtgaatgactacatggaataaaaggaaaaaatatcttctacagtataattccaactaacaatgtagaataaaaggtggaatcaaaacatcaccattttgcaaccaccacagaaataattgattcaggcaataatcatcaatgaatactaaaactattggatgaatgtctgaggaggaacaagatacatacatatatatatatgtatagttttaaaatatcttcccacaaattacttataagttacaaagaaaaaatgaatagtaacttggtatactagaaacttcccagatgctaccttaatcaggtaatcaaagtgaacatcaccagtaatggaacaaacctatttcacatgcctcctaatgagatactctgagaagattacaggatcacttctaggtattcctgccaaaaacgcataacctgcatctaatagtgaagaaacatccagcatacctaaattaaggaacattctacaaactgactggcctgcatctttaatacttaaggtttaaaagaaagaaagctggaggaaggttgcagattataggaagctaaagatacctgacagtcaattgcagtgtatgattctggattggctcctgaaccaggatgacagagtataaaggatgctactgagaaattgatttgcatagaaattatgaattagatagtagtactataataatgcaaacatttcctaattttgagaatttttctatggttgtgtaaataatgcccttggccgggtgcagtggctcacacctgtaatctcagcactttgggaggccgaggcgggtgtatcacaatgtcaggagttcaagaccagactggccaagagggtgaaaccctgtctctactaaaaatacaaaaattagccaggcgtggtggcaggtgcatgtaattccagctacttgggaggctgaggcagagagctgcttgaaccccagaggcagaggtagcagtgagccgagatcgttccactgcactctagcctgggtgacagagcgagaccccgtctcaaaaatatatatatattaataataatgtccttatttttaagaaacaaatactaaagtattttaggggaaaaacgggcatgatagctcaaatttattctcaatgatttataatttattctcaattacttatataaggaagtaaacatgtgaaaacaaatgataaagttatgcagaatgttaccaattagtgaatctgggtaacattctataagatattttatcatgtttttcctctaagtttaaattatatataaataaacttacacttaaaaaataattcaaagcaatcctgagacactgtgacaattcagctaaatttggagttcccttagttttcagccaccttaggggattgttttcatcactgatttttagtgggaaatggagtatttcccaaagtgatacgaaagaattagggttttttttctgtcttttttgagtgttatatagctctgcctgtgtttttgttgttgttgttgttttgtttgttttgttaatcacattcgacttcagatagacctgttttcttctcaggtggcttccgtagaaattctaggcactgaatctactccggggagatcggttcctcggaaactctcatctgcctcacctccattactgtaataggctgcacaagcatgagcagtgggcttgccaagggctttgagcaaacaccctgtaggtcctgctgcctggcaggctggatgtccgcccagtcctctggtaacctgaagggcaatgaggcttcatgatcctagaccaaggtggtaaattccctttgtggatagcatcaggatgcaggtagctttgctgagcggctcagagctagaatgtagatcaaagagttacaaacaagtgggtgcagatatatggcaaaagtcagtgtgggcttttcatatgtcctttgacctcccactcaatggtacaaataatttataagcagaatttaactaaaatcctacatgatccagtgtttgaagactgttaagtcaaaagcacaaaataccaacagataaaagatagaactgaaagaaatttcaagttttcttcagttttaagaaaacataaatggggacagggtaccttttaatgtacaacaaaacatctaaaatattctttctcggtatctctttcattttttactcaaactaccactctctctgaaactcacaaccatttgctttgagactcttaactcctcctacttcttaattcatccaacaaataattatttagcacccactcaattccaagtactattctatccttaaagatgcagtggtaaaagaattagatgcaaatttctatctttctggatcttatgccttgtaaaaagaggcattggataggggaaaatggaggggagcagttaggccatgtattttactgagaataggatgaggaccattgcaagttttgaaggtaatctggcttacacctttaaatgatcactctggcctgggttcaggacacacaattagaggcaatggaagaagacagttaggagactgatttggtcccagatggtagcagtagacgtggtgtgtaattataagattttgaatatgtcttgaaggtagtgctgataggattttgtatgaataaagaatgggatgttaaaaaaagaaaaaaaagagacgtcagaacgaccccaaaagtttggccagaacaactgggaagatgacacattggcactgactgggatggggaagaccatagaaggagcaggctgggaggctgggagtctggctgtgggtgccttttccacagcagcagagcgagcagttcagggggaggcccaggcagtgatgttgctttgggcagaactggttcaggactgtcgcataagatttctgtgagcaacaagattataaggtttatgtggaaattcttccacaactgccagtatcaggaatgattattctgtttattttgtacttatgctctgtttctgaagaagcagggaggagcttgtttagatagacaacagcgtaatcatagcgtcttcccaagcatgaggccaagttttcataaatatcaacaaggtggtctaaaaagcttgcactgcttttctaagaatggttctctcaggaagagacgatgcatttacttttatgctaatgaagaaagaattcaatatgtgcctgaagcacagaggtcagaacactcagctggctaataaagtgagcagccttattcacactgtggggaaagagtcataaatactttcttacctgcggtgggaagctaagacaaatcttaaaatttatttaggctttgtttactctttggcccttagtcattatcaaaattgccttatccttcgacaacagaaagccagttaattattgctagtgtttggctgtagctttggtcaaagttccttgctttctttctgaactactatgaaaagagcaatcaagtttgagtcagaaaatctgggtttatgtcttggttctgtgtaagcgttcagcttagtggcatttaaagaattaaataatgatacacatgtctgaaaccattctaaaaacaaatgtagttctgttatttttttctctcctgcttccttgttcttctccctttttctcaagtttcaaaacccccagggctaaaatcatgctctaggtaaatagaagactgagtgattgattgaaaagagtcttttaatgaattgtactttttgaaaacttccccattgctctttaagggtaatttcaagaaagtgtggggaaaaaacagatatctgaatggcaaaacagatccaaaataaggcagatggaaagagatggaaaaaattttatacccatacagtttagctctggggaaaggcaaaatataaaggatggcttttttgcatgataagtaggaacagacccagcactgtcaccaggctttaaatgagttatttttaaatgtatttggcatattttcactttagccaggaaatctagatgaaaggggcatatatattctgtaattgcagataaattgcagatgggaattgtgaataccagaatctgcccaggtctggcatggagtaaggggaagatatgtgtcatctgacctttcctctggggctgctggctgaggctgacacagcgaaagcctccaaagggtagggggcatgacagtccactcttctggagcttgtgcgattaagagtttctcggtgtcctttaacctgctcgcccttggctctcctagacactttctcttgaagtgctggagacaggacaaggcagggggaggtgtgatggcactacagtgtgagagaaagacgaagctgttctcttccttaggccaggactggtgaacctgggacattcacctatcaaagcattcacggcaaatagccctcattgcagggtttcttttagctcactagatgctgacaccttttatttatacaaatccaatcttatattttaagaaaacatctgaaagatgcctcattttgcccatgtctacaatatttggaagatgtcatgattttggaaaaaccaagactaattgtactttttatttatttctaaatgttgctgattttctactaatttttcatctgtcatatactcagcatcacaacaaatgttgatttttagtatcaacgtttatttttctgcttttacattcaaccgtgttttccaagtgatatgagatattttgtttctttcccctttttttttttttttttttttttttggccaagagtcaatgaacttgaacttcaaaaggttggagtcttgtttagaaaaaattttgaaatataaagtctaattaacgaaaaaaatccttggatggaaccatactcccaagattaatatagggaataaatagctttgtcacaaagctgcctgtcaccatatccaaagtaggataataaaagtacataaatgcattatttgaatattgcatgcaatcctggcaatatattttctaagaaccagcgtgaaggtggatgtacaggacaatttcccccatccagtgtctgtagatccataacaacattttaagaaaaaaataatatccttcactgctgcccttgattggcaaaactgatgaaaaatagtcacagataactctggctgacaatataaacatcctccacccatcctgcaggttattaacaggtgtcaatcaaaggtggaaatctaatcaaatctcagtgcaattccctaggaaatgatggaaccaatatcatctatgaaggatcaactctcctcccacctacaaacaacaaaacaaaacacccttcctggcaccaactttattttctgggagcccagtctgcttaggaaaggaaaagtcaccaaagttcattgttttcctaggcagttggtgctccatgagtttaaagggagctccagatgggcagagatgatgaaagaatcatccaagtgaaacacttccctcttgggtgttaaatattgcatttactgtgtccatggagctgttgaaaccaatagaactaatgagagagctggtatctgagaaagactcgtactaactaacactggggacaacatgccaaaagaaagagccaagtgacctcttggagggcagggacacagggagtgtgatcttggaaaagctctctccccagccagaagcaaaagaaagggagtcatatttgcccagggacacttgtgttttagtctaaattacagtgaagggacatatggaactggaatagacagggaaactagctaccgtgccagtgggtaaatgattttcttttactattatattgtaaatggcaccaagtattctgctggggtcatagcacatttgtgcatttttttctcattcacacagaactaaatatattacccaaaacaatggtcggaattctattttccatggaaaacaaactggcttagaggaggagaataatgttgctaactttgacccagaaacacctcagctccttatttgggggctgttctaatcactttgcacttattatctcagtttttctcatcaaaaaccatatggataggtattattattatcattcccaccttacagatgagtaaacaaaggaccagaaaggtttactaactgcccaatggcatggggttaatgagtgttcagagtcaggtttctaaccccaaatgcctccctgttccacacacctctgtgcttctctacttagtcatgcccttagtggtgctccagtttataaagggaaatgctgttagggaatttgtttgccacctgactcttatatctaggagggaagtttgggggtaggaaaaagaatcccatagattatcagagctggagctactgcgtttgaggctagggcccctgcagcactgaacgaatgaaacacactgaacccagaatgagaagatgcacttgctcccagtcacgtaaaacatccccacctgagctggagttcagagaccaaccccttgactttaagatcaaggcccttctcaaaacactatccttctttcactaacatggcaagctagtttatgggtcagaataaatgtaggatcacgcacgggggcctgtgacctctgctatgggctcagagcctaagtcacacaacaacaagcaagttcccaagttcatgctgtgggaacaccaggctgaacaaaactggaggacacatattttctgtactcgaatgtaaggtgctcctggtaccacatttgttcatcaatatttaaacatagtgccatagtcaccactattaagagcacttattattctaaggtggttactctgtggacaatatgtactccagatctcaaaatactaaatttaccatttttattttatccatgtcttttgacttcatgttaccttaatggaccagaacagggttgttcaaccttaccacagtggactttttggattgaaatatgctttataggtacagggttgtcctatgcattacaagatgtgtagctttcctggttctgctcaccagatttctgcggcatccttcacccaagtcctgtcgaacaaaaatgtctctagagattgtcaaatgtcctatggagagcaaaattgtctttggttcaaaattgctgggcttgaggcttcctgagattaagtactatgcattctatctcctctaggtttatggcttattctcttcagctgcaaaatagacggttggatgagataaatttaaatttacattcccactctcaaatgcaatgactcacctccctttctaggtctgatcttccagggttcaacaatgcttcctgacagggcaaaatcatggataagtcctgaggcaatgccaaagaggtcaggtcaccaggtagactacccaaaaagcactcttttggggtcatggtgaaaggtgaagccagctggacttcctgggtcgagtgggaacttggagaacttttcttacaagaggattgtaaaatgcacctatcagtgatctataaaaatgcacacatcagcgctcagtagctagcaaggggattgtaaaatgcaccaatcagtgctctgtaaaacgcaccagtcagtgctctgtaaaatgcaccaatcatcaggatcctaaaagtagccaatcgcagggaggattgaaaaaagggcactctgataggacaaaaacagaacatgggcggggacaagtaagggaataaaagccgaccacccccagccagcagcggtaacccactcagtcctcttccatgctgtggagtccttgttcttttgctcttcaaaacaaaccttgctactgcccactctttgggtccgtgccatatttaagagctgtaacacccacggcaaagttccgtggcttcattgttgaagtcaggaagaccacgaacccaccggaaggaaccaactccagacacagtgggagcaggtaataaaaactaaccagagaacacagaaggaaaactttgtgagctagagaaaccaattaacctcatgaaaaatagaaagagcggccaggaaacccagtaaagacattaagagtggacctagagagcaaaacaggtaaacgcaggtaagtcagtcttgttttaagactgttagcttggggatgagtcctcatgaggcctgcaaagggccctgagcagtggagtcaggcttcctgcatatggaaacacgtattcagcgggcactccgtgaatgcgtttccctgtctggtgtggttagtaaaatatgtttcattatgtatttcacatttttttttatcacctgtagtttgcaaagcgctgtctttggtaacaatgggagacaaaaagattaattaaatatggaatttgtctcaatgtgacttaaaacccagcaagtgtggtatacttgcagacaatgaacagaagagtaaaggggatctgaggaagagccagacaatggttagtgtaggctcagaatggaatagccatatatgtgtgtgtgtgtgtctgtgcgtgtgtgtgtgtataatgtagtggcttctttacaagattcctaacgctcccatttaccccgctggaaagctctagcgcacgacattctaaccgagctcaggtcaggagacttcaggggtatttcctccttgatgtatgatggattgttgattgcaattttagtgggaagaattaaatttgcgttaggtatgtttagaccaaaagtctgacgacagtccactaagtaaatgtgtagccaggtatctgtgcactttgaatcctataatttagcaacatacagtcacctagaagaacaacaacacccttctaaggactaagactgaaaactgagttgcatattaattcgcagcaattctcctctggccccatctgaaagtgtaccttgacactgatcagcaaacgtaagccagccttgtttctaaaatttaaaaaagaaaatcttttccaaggcttatttctttgctaatttacttctgtcttgatctaaagtgaaccctctcctgccataaacaagaataatttggctgctctgcttttgtgcatcctgagccctttcctttaacaatcttgatgagcatgcggggttgtgtgctgcataccaatagccactccaagcctgaaaaagaggtagtcatcccaacccacaccatctgtggtctcagctagatgtgtggcatggctccctgagctggagcaaacctccctctgtctcgagtacgttgagaatcagaaataaaaaataaattaagacaagtaggcaaacattaaaatgagttgttacagaacatttgtgtagattccaatcttcagtgtcaagagagcatcattctgctgtaatagtatcttttcatgaaagcacttcaaggcagtcataaataagagccagtgaaaggaatgacaacgtcaaaatggaaactgagtcaggaagggtctttattatcgttcagacaaagcgtctgtgactatgaagagggaaaggtgaatggcaacaatgaagaaaagaaacccagctattgtgttgctgtcgtgtgcgtgtcaacagaaaatctggctctggtgggctgacaggttgtctggataaataggttggggccagaaatattcattgatgatgagaagtttcttcttacagcttgtatcaggagctccagaagcatggacaaggacagcaatgcctctgtaaatcagtgagggcattttgtcgtttgaaaagcattatctcagcgtctgtccaggcagttttgaagagtctctccctccccgttatcagagtgcagcagctttaaatgcagatagatgtcctctaatgaaaatcacaaacagaagtcttcagtccttataagttccagttaataatctacttctatacctcagagtttgtctaaatatagagccacgtgttcaccactgacactacagaagggcccactgttctaccacaggataggtgtcctgcacaatcttcctcttggatggagaagagaaggtggcctggggctagagagagttccctgttgatccaagtattattcatctagaggtccttggccttgttttccctgattccaggtggggatacccaagaccggaacgtattacctactgagttgaaagtagctgttctttggagagctttcccttcatggcagttaacaaagggcctgtctctgcctctggtgcagtgggcagtctgcagtctattttaccttgagtggggctaggccaagagaggcatggtacaaggcgaggggaatgacagcagatctgataagcgctgtgcttctgaagtagtatcatgcatttgtatttatgtttatgtagtgtatatttactttttatttttgtcttctccactcccccatcctaagcagctgactttgacatgtgctctattgtctggtcctggatatgtcatttgtgcttacatttgctttgcagtttgctatttgaagtatcattagttgcttcctcatcctggctttaccatcatcccatttgccatctggatgtagcacattgctataagcactgcagccccatatacacaattatgtagttccttacactgctaggggagtttgttatttctttagaaaacaaggatgcgatgtgcataaaagcttgagctctgatttcaccatctaaggcatttgataaattctttgggactatttctagttgccatcatcatttcttgcagaaagtctgcgttatgtatttccatgtactctaaagagcatatcagagtttgctaaatgggtgcaatgcttgccttctagaaacctgcaggcccaaatggacagcgtgagcatacgttgatgatgatatgcaactgcacagtccataaaacttcttttcctccaatgagtttttgaccgaagtaaattgataaaattattgttaaatgggtgagagggtatatatgcactattgagcaattggagcaactgttagaacggggaatgaggaattttaaaacattataatagttcagtttggccagatctgtagtggatctagataaaatattatgttattttaaaaatggcaccattgaacatactgattttctacaaaagtattctttttttctttttttttttatttttaagatggagtcttgctctgtcgcccaggctggagtgcagtggcacgatcttggctcacttcaacctctgcctcccgggttcaagcgattctcctgcctcagcctcctgagtagctgggattacaggcacccgccaccatgcctggctaatttttgtattttttagtagagatggggtttcaccatgttggtcagccttttctcaaactcctgaactcagatgatccacctgccttggcctcccaaaatgctgggattgcaggcatgagctaccgtgcccagcctctttttcttttgcaacccaataatttcagttgccctggctaaaaacctctaaatcctttttgagccatttttctttttccaccaaatcaaatttgtcatagtcttaatactttcattctgaatgtatcttcacatcttgccatctccattttcagcctacttctgaaccttggcaagtctctctaagacaattcccttacctttgatttctgctcatttcaattcatctgcccactggcactaaacaatggttctcacatgcatctatcattcatgattaaatcaacctataccttttcttcatttcctgaacctagaaaatcttttttttgtatgatgtaattataaaaatcttgtttacactgcataacctcgttaatgaagccctcagcaactacacttagtctgaataagactttatctgccttgaactttgagctttatcggcaccacaggtacataattaattgttgtctgaattccttcagatatgcatttacccctgtattttagctctaggccttatattttatttttagccaccatctcagcaagcgtaaagtttattgaacacgcatagtaggtgaacaaacctttgattatttttccaggcaattctctaaaccataaagtttaaggatacatatcaaattcttaatgtgcctaacaattcattatacatctataacacataatttgtacaaaattattttggcctattaatattttgctttatattacatctcaagttagctggcattagtggttgaattctgactgagagtgacctttataggaaaattattcctacagtttttgatcttgaattgggccttaatatttttcactctaacttggttgtgaaccatgatccatttaattaaaatccacttttagatacaaaataaatcaacaatctgaaggaaagtgaaatgtcacattcttcagccctctctgttgagtgctctgaatttcttcttgaagcatttgctgaaggcatttataggcccttttcaccagaaataaaacctaacaccagctgagtcagaatcaagattagttcaaatcttggacatgttttactttcaatgtttttccatcttagcagcactctgagttcatgttttaattgccatatgcatccaggatgtatactttcaaagcatagacaggcagaatgccaaaacaccacaaaatggagaaatgcccaaaaaattgggatgtatcgctaaataacttgttttataaaaatgttcttctttttttccaggtccctatgaatttagggtaagtttactctcagtaactaaacatttggatgcttgggtgagctagactctgaactccttgaggtttgtggctctcactcatgcctttcggtctaatgaagggatggggaggaatttatgatgactcttccgtactctggacagctcctgctgcctgcctgccatggaaaagcttcatcaacagattgttaatttccctcctttctccctgaatagcattatgccttctggcaggaagcactgtgttgcatccatccatgcgctctcacctgtggacatgtggagctgtctaatgggctcctgctttttgccccactgggctgtgactgagcagggagacagagctgtacaagttgctaattgtctcagcctgtaactcttgaatgatgaaaaagattaaaagggaaggaaaacagctattatatctctttcctgaaaaaacttgcactgtgaaaggctcattaacatcattagtgttccattaacctctagccagacaaataagctggaggtaatttcggagcatggggagaaagaaaaagagagaaaggaatttaaaaattatctgggtgtaggtgacatttcccaactacctcgattgaacatttggacagacaccagcaactttacttactttaatgccagcctggtactggagggtggccagaactctggctgctaggaaggcctgtaggtaatagtgagtggggagatgcattgattgggacaaaatgaaattcatttttaacacaacaacacatgaaatcttgcaaagaaacactgtgtgatacaatagaagcttaaaaatgtctactgcaaaattatgttccattgtatgaacaaaaggcttttcaccttgtaattttttcctgtcacattttgttttattctaatccacacctccatgcctggccctcgttgtttgatccccagcctcactaactctgctgcaactcaggaagttgaatgcaaagcattgttcaggctattgatctttaggtttcctggtatagagggggcacttttttagatggggacatattttagattttatttttgatttaatctcaaaatacaacatggattttggtgactcagtttttcttcctataaaaagaagactctataagtttcccaagtattctgtgtggaaactagtagacgtgtaaaggttgatcaaatagaataagtactaaaactatggtttacaatgatttaatacaagcctaagcaaatgcgtaagttaaaaatgtctgtctcaaagtaggaatccccagatcactattagaaaaaaagtaatgttgtggttttggtattaatttttgatgtaaaattgattttcattgtgtcccttttttggattcaagtatgagaagctgacgacaacagtcaaggtagcttcagagggatactctccccaggagccactggtcattctcttccccagagtggagatgctggctttctgctgagaacctgatacagttcctagggctccactcccttgctttatagcccatagtcataattctatctcatttagagagatctcagatttcacatcaacacagacatacaattttgaatagtcaaaatcaaatttggcatagttttttttgttgttgttgttgtttgtttttgttttgtttttgtgtttttgagatggagtcttgctctatcacccaggctggagtgcagtggggcgatctcagctcactgcaagctccacctcccgggttcactccattctcctgcctcagcctcctgagtagctgggactacaggcacctgccaccacgcctggtgaattttttttgtattttttagtagagaagggtttcaccatgttagctaggatggtcttgatctcctgacctcgtgatccacccacctcggcctcccaaagttctgcgattacaggcatgagccaccgcccctggccaatttggcctagtttttgagaatgcatttcccagaatagtagatgtttaagagcttgtctcatcctgagaacaattctcttagccctgatggagttgtttagatcttttttccagaaattttaggatgttagcaacagagatttcccatataccatctgcccctgttcatgctgcaaatctgctgcagtctccctcattgtcaacatctcacactacagtggtagatttcataaaattgatttaactacatctttgttattcaaagtccatagtttacattagtgtccacttttgatgttgtatattctatgggttttgacaaatgtataatgacatgtatccaccatgataataccatacagaatgattttactgccctaaaaacctacctattcatcacttcctcctaacacttggaaaccactaattttcttactgcctccaaagttttgccttttgcataatgtcatattgttggaatcagacagtacatagtttttacagattggcttcgttcacttggcaatatgcatttaagtttcccctatgtcttttcttggcttgatagctcattccttctcggtgctctataatattccagtgcctggaagtaccacagtttatccattcacatactgaaggacactttggttgctcccaagttttggacaattattaacaaagtttccataaacaaccatgtgcaggcgtttttatgggcataagttttcaattcattttgtggaaaaagcaaggagcattatggccagatcatatggtaagagtatgtttagttttgtaattgccaaactgtcttccaaaatagccatacaattttgcattccaaccagcaataaataagagtttctgttgttccatatcacatcctcatcaacatttgatattgtcagtgtttggatttttgtcattctagtaggtaagtaatggtgtttcattttaatttgcaatttcctaatggcatatgatgatgctgtgcaatttttaaatcaggttgttatatatttcttgttggattttaagaattgtttctatattttggataatagttttatttaatcacatatgcctttaacaaatattttctcccagtttgtggcttttcttctcaatctcctgatagagtcaagagtataagtttttaattttaatgcactctagcttatcaattatttctttcatggattgtacctttgctattacatctaaataactcactgttgtgggctgggcgtggtggctcacacttgtcaccctagcactttgggaggctgaagcaggcagatcacaaggtcaggagttcaagaccagcctggccaatatggtgaaaccccgtctctactaaaaatacaaaaattagcggggcatgacagtgggcacctgtagtcccagctactcgggaggctgaggcaggagaatcgcttgaacccaggaggcggaggttgcagtgagccgagatcatgccactgcactccagcctgggcgacagagcaagactccgttcaaaaagaaataaataaaaataaaataaaaataacacattgttgtatccaaggtcatctaggcttctcctttgttatctcctgggcgttttatagtttcgtattttacatctgggcctatgatctattttcacttccttttggcaaaaggtataaggattatgtctgcattcatttttgtaatatgtgcatgtctagttgttccagcatgattcattgaggactatctttactccattgtattgcctttggtcttctgtcatggatcagtttactgtatttgtgtgtgcctatttctgggctctctattctgttctattgatctatttgtctgttctaataccaatatcacagtcttgattactgtagcttcgtagtaagtcttgaagtcaggtagtgtcagtcctccaactttgtttttctccttcaatattgagttaactattctggtttgttttcctcttcatataaattttagagtcattttttcagtatttgcaaaataactttgcaaaataacttgctggtattttgtttgggattgtgtttaatctatacattaagttgggaataactgacatcttgataatattgagtcttagccttttacttttttataacttttattttaggttcaaggggtacttgtgcagattttttacatgcgtaaattgcatgttgctggggcttggtgtacaaattatttcatcatgcaggtagcgagcatggtacctgataggtagtactttgatcctcaccctctttccacccttcctgctcaagtagactcaggtgtctcgtcccatctttgtccccatgtgtactcagtgtttagttcccacttataagtgagagcacatggtatttggttttctggttttgcattaatttgcttatgataatcgcctccagctgcagctatgttgctacaaataacataattcctttctatttatggctgcatagtattccatggtatatatgtaccatattttctttattcagtccaccattgatggacctaattaagctaaagagcttcacacagtgaaagaaactatcaacaaagtaaatgaacaacttacagaatgggagaaaatatttgcaaactgtgcttctgacaaagggctgatatccagaatctataaggaacttgaacaattcaacaagcgaacaacaaataaccccattaaaaatgggcaaaggacatgaacagacagttctcaaaagaagacagacatgcatccaacaggcatatgaaaaaatgctcagcatctctactcgttacagaaatgcaaatcaaaaccacaatgagttaccatctcacaccaggtcagaatggctgttattaaaaaatcaggccaggcgaggtggctcatgtctgtaatcccagcactttgggagcccaaggtgggtgaatcacaaggccaggagatcgagaccatcctgactaacaccatgaaaccccatctctactaaaaatacaaaaaaaaaaaaaaaaaagaaaaaaagaaaattagccaggtgtggtggtgagcacctgtagtcccagctactcaggaggctgaggcaggagaatggcatgaacctgggaggtggagcttgcggtgagctgagattgtgccactgcactccagcctgggcgacagagcaagactctgtctcaaagaaaaaaaaaaaagataaaaaactaacagatgttggcaaagtttcggagactattgactctatttatgaacatgaaatatctcttcatttatttagtttttctttgatatctttgtagttttcttcatatggaatttggtagttttcttcacataggtcttgtatatgttatcatatttatctcttttattttgggggtgctaatattgatggtaatgtggttttattttcaaatgtcatttgttcattgccggtatataggaaattgattgaattttgtatattaaccttacatcctgtaaccttgctataattgctaagttggtttctcttttttgttgttgttgattcttctgtatttgctacatagatgatcatgtcatctgcaaagaaatacagtcttatttcttccttccccatctatatgcattatattttcttttattttcttattatgttggttagaatttccaatacaaggatgaaaagcagtggtgagaggaaacatctctgacttattcttaattttagtggggaagtctagtttctcaccactaagtatggtgctagctgtaggttttctggagatgttctttatcaagttttaaaattttcttcctattcctagtttgctaagagattttatcatgaatgggtgttggattttgtaaaatgcatctattgatatgattgtgtgatttttctgctttagtctgttgatgtgatgaatagcattaattgtctttagaatgtttaaccagccgaatgggcacagtggctcacacctgtaatcccagcactttgggaggctgaggcgagcggatcatgaggtcaggaaaccgagaccatcctggctaacatggtgaaaccctgtctctattaaaaatacaaaaaagtagccaggtgtggtggcgggcgcctgtagtcccagctactccagaggctgaggcaggagaatggcatgaacgcgggaggcagagcttgcagtgagccaagatcgtgccactgcactccagactgggtgacagagtgagactccatctccaaaaaaaaaaaaaaaaaaagtttaaccagccttgcatacctgggataaatcccacttggtagcagcgtatatttctttctgtacattgttggactgaatttgctaaagttttgttggggatttttcttctgtgtttatgagaaatattgatctgtagttttctttccttgtagtatcttttatggttttggtattagggtaatgctggcctcatagaatgatgaagtattaagagttatttcctctacttctatcatcagaaagagattgtagagaattggtataatttcttccttaaaaatgtagtagaattcactggtgaaaccatctgggcctggttccttttgctttattaaactattaactatttatttaatttcctcagtcaacatgggactattcagattgtctatttcttcttgtgtaagttttggcagacatatctttcaagaaattggtctgtttcatataggtcatcaaatttgttggtacagagttgttcatatttctttactatccttttaatgtccatgggttggtagtgatgtcccttctttcatttctgatactagtaagttggttgttctctctttttttcttaattattctggctagaggcttattcgttttattgatcttttcgtagaaccagtttttggtttcattgattttctctgttcattttctcttttctatttcattgacgtttgttctaattgtactatttattttcttctgcttacttttgatttagcttcctcttcttgtttctagttttctaagtcagaatattagattgttggttttagatcattcttctagaaatctccatctaagcatgctttacgtgcatcacacgcatgtgataagttccattttcgtttatttcaaaatactttaaattttctcttgagatttattctttgacccacgggtcatttagaagtggattgtttaatcttcaagtatcttaagatttttccagtgatcttcccgttattgatttctagtttaattacattttgatgtgagatcacacattgcgcaatttctgtcttttacatttcttaaggtatgttttcagttctggatgtggtctgtcttgataaatgttccacatgagcttgagaagaatgtgtgatcatgtgttgttggataaagtagtctatagatttcaattatatctaattgactcatgacagttttgagtccaactatgtccatactgattttctgcctgctggatctgtccacttctgaaagagggacaatcattaaaatccccaactataatcatggattcatctgtttctccttgcggttctatcagttttttgtcttgtatattttgctgctctgttgttaagtgcacacacagtaaagattgctgtgtcgtcttggaatattggctcctttatgattatatattgccccatctctatctctgatgacttaccttgctctaatttcagatttcaggaaatctgcttcctgaaattaatatatctgctcctactacctctaaatagtgttaccatggcatattttcttctgtctctttactttttatctatataatatttatatttaagaagggattctgtaggcaatatatagttgagttttgtttttgacccactctgaaaatctctgttttaatcgatgttttcagaccattgatgttaaagtgcttattgacagttggattaacatgtactctatgtgtcactattttgcatttgttgcccttattctttgttcctatttttttgtcttccacaccttttctttcttttgtgtttttaattcagcattttacataatctcattttctctcctaccaccttcttagcatttcaattgtactttttaaaaaccatttttttagtggttgccctagagttcacactatacattcacaactaatttatgtcaactttaatataataatatacctattcatgggtaggaagtatcttaaaggtagttcaagtaccttataataacaaaatattcctaaattcatttattccccatccattgtattgttgctatcattcatttcacttacacataaacacacacacacacacacacacacatttgtgcacaaataccttgttgctattataactttgaaaaaaacataatctgttagatcggtgaaggattttaaaactaaacattttgattttacttattcattcttcagtgcacttcctttatgtagatctgagtttctgacatatagtttatttctaaataacttcctttaatatttcttgaaaggcagatttactggcaacacattttctcaatttttgtttgtcagagcaagtctttctctttcaccattgaaggataatttcttagggtacagaattcttggttggtgttttgtttcgattttctcaacactttacttgtttcactctactctgtacttacatggtttctgagaagtcagatgcaatttttatcttttctcctctgtagataaggtggtcttttcctctgatttttttttgtaatttttttcattatctttgattttctgaaatttgaatatgaatgtgtaggcttttcttattagaattcatgactactgtatcagtagttccaaataaaacctttcccttcactagcatactagatatactttaaataggtaagatttaaaataggtaagctttctgcatttttttgaaggtactaaatccatcctttcattttctcatttatttacttccttcatgcctgctaattattggtattttgcaagatactaaagattaaatgtcatgatttttccataattccttcccataactcaaacctgagattatctcactccttccctttggtttcttaggtcccgtggtctttactctgtcatattcaccctaaacaaaaatacacgtgcagctgcaaaaaaaaaaaaaaaaaaaaaaaaaacatttacattaaaatcatcttagtctcagcaaattgggccaacagggctattttattggaagatgtggctagaaaacatcttagtagatgaagatgagcatacaatttattgtatgttgatccaatgagatactgtctggcaccaatagaacagctacatgattaatatgccaatgttgaactttgacacaaccatatcgtgtggagctccagtatctctcgacactcttgatttccccttgggaatataatgcactatatgatgggataactttccagtgcatacataattgaactttgtatatgaaataccagcaagcagatgaataaatatttgctcaaacctgctatttgaatgccctgcatcactggggtaaaattttaatattatatcccagtactatttttatattcatgttgtcatgaaatcttcccaaactcaaacatctgttagatacatacttcaagactcagttattgcaaactcatttctagcatctcaagagaactttaatgcaggtgtttgagtgtgtaagcatatagttcattccagacattggttccctaataagttgtgactgcttttctctctcttgctatttgaataaacaaagactcatagttagttctggtgatttaggcatttatccagacacttgcatcatgatagaagctgcagaatatagtctactaacaagataaacaactaaaaaatgcttctgagcaaatttttgtttgtaaaaacatcagtaataccatttgtcacctgctctaggtcattgagatggtggcattgaaaggactgacaaactggaatgatttgcaaagcaactggaaaggttgactatggctctttaagggatcatcatgggtcgtagacttgaaaataatatctgaacatttgcccctggtatgacagatttttagtatggaattttcagagtcctaaactttgtatggtaaatttggcctttaagcaacccgactttagccaaatgcagttagtgttaaatattttactgtgattcaccttcttggctcaaacatataccatttttttatttaaagaaactttgatctgcaaacctcaaaggcaaagtaattaacagctactctcgcatcactcagtacaggtacataattatagctgcacctgcatatttttttttactgaaatattttatcccaggtccagataagtagaataatgccattaaaataaggctgatatttagacacacgaggggacctgatttttagcactcagatgacagcagaaaaaataaaccacatagacaatgcatccaccggacatatccttccacttacattcgtgactttgacttaattttatatttcctcaaagattaaaattaagatttatctattctgtttttcaagtgaattgaattgactgatgtgaatgcagagatgacatttgcatcgtgctgccttcttttcccactgcattactctgatggctcttgtttaaaaaaaaaaataagtacagattgctaaccttagcatgaagaacctacacagtctatattcaacgtcagtcagacacatcacctggagaaaaaaccgtctactccagtgaacctgtattgttctaagctacagttaatgaatgcctaccactcacctgctactggcttttgagacagaccaatatgggcttgaatttaggccccattttctgagagtaataccaatttcatagatcactatgagcattaagtggaattctaatcataaattacctacgtttgtgctgggcacataacagttgcttgataattatagttacggggagcaaggggagggagagcattaggataaatacctaatgtacgcggggcttaaaacctagatgatggattgataggtgcagcaaaccaccacggcacatgtatacctatgtagcaaacctgtacattctgcacatgtatccgtgtatcccagaacttaaagtaaattttaaaaaaaagaatgaaaatggaaaaaaaagaacgatacattggatttgggggacgcaggggaaaggttgggggggttggcaagggagaaaagactacacattgggtacagggtacactgcttgggtgatgggtacaccaaaatctcacaaatcaccactaaagaacttattcatgtaaccaaatacccctgttcatcaaaaacctattgaaatacaaaaattaataataataattattatagttactatgcatttatcaaagatttgtgttccaagttacagactctaattcaaagtgcctaggaaaatagtggggtttattagatgaacactggatatctcttataggcaaactatgggatgagaatgggtgcagctgggtctcagggataactggcactaggaactaaatgctgttgccagaaatcctctctctctctctctctttctctgtctctctcctttctctttccaccatttgctcctttatctcataaagatgtaccaaccttctcacagagaaagaacaagataattaacagctcttgagttttgtttttgtttgtttgttttgagacagtctcactctgttgttcaggctggagtgcagtggggtgatctcggctcactgcaacctccgcctcccgggttcaagtgattcttctgcctcagcctcctgagtagctgggactacaggtgcgcgccaccatgcccagctaatttttgtatttttagtagagacaggggtttcaccatattggccaggctggtctcaaactcctgacctcatgatctgcccgcctcagcttccctcccaaagtactgggattacaggcatgagccaccacacccagccagctcttgagttttattctgtgattgaccctcattctttgtggttctcagtctgaaagtttcagggaagggctccactttgttgaccttgtattagatgcccagctcttttcatcagttgccttggtctgtgctgctgtaacaaaatgccacagaccgggtaatttataaacaacagacatttatttctcacaattctggaggctgcaaagtccagtaacaaggtgccgagaggttggtgtctggggaaggctgttctctgcttccaatgtagtgccccgttgcctcctccagagggatggatgctgtgtcttcacatggttaaagaaatgtaagaagtaaattcaccccctcaagctttttcatgaggttgctaatctcattcatgagggctgcaccctcatgacctaatcacctttcaaatgccccacctcttacagctatcacattggaaattaagtttctgcacacgaattttggaagatattcagactataaaattccacccctacgcctccaaattcatgtcctcacatgaaaaatatattcattccatctcaatagccccaaaagtcttaatgcatttcagcatcaactcaaaattctaaaatctaaagtctcatctaaatatcgtttaaatcagatataggtgagactcaaggtacaagtcatcctgtgagaaatttccctccagctgtcagcctgtgaaatgaaacaaattatatgcttttgaaataccatggtgggagggtcataagatagtcatccccattctaaaaggaagaaatagggggaaataaagggtagtaggtcccaagagaatccaaaactctagggcaaacgacattaaatcttcaagtttgtgagtaatcttctttgaccctatgtctcacctcctggacacactggttcaggggttgggcccccatggcctcaggaagcctcacctccacggctttgctggggatagcccacacttcagtttgcattattgaagaggtgcgtgactgtgactttcccaggctggcgttgcactctggtggctgtacagttctgtggtatgggggagactcattcccacagctccactacacgtggctctagtgaggatgctctgtgatggccctggctctgtggaagttttctgcctgggccctgaggctctctgaggcatcttttgaaatctaggtaaaagcatccatgccctcacagctcgtgaactctacacacctgcagaattagcacaatgtggacaccaccaaagctgaccacttgtgccctatcaagtggtggcccaagctgcacctgggtccacttgagccacagctggggaagccaaggaacattgcagcagaatgtgagaaacagagatgttagtcatccctgggtcttcaggtttgaggtcccacaggtgccctgggcttctcctttgaaactattctaccctcaaggccttagcactctaggaaatggcatcactgataatctctgaaatgccctctgggtcattgtttcattgacttgatgaatagcatctagcttctttctaaccatactgatccttatcaaatggtaggttggccatactctgggtattctctctcaaacacacttttctgttcttcacaatctagccaggctgaaaattttcccaatctttaagttctgctttctctttaattataaattctgtcttcacttcatttctttcttctcatattttcatataagctgtcaggagaagctgtgcagcaccctgaacatttgcttggaggtttcttttgccaaatttcctagttcatcactcttaaactctgctttccacagagcactaggatatgaacacaactcagccaggtgctttgccacttggtaacaatgatggcctttcttcctgtttctaatacattatttctcgtctccacctaagacctcatcagaatggcctttgccatctatatttctaccaatattctgttcatgaccactttgataatgtctaagaagatttaggctgtctgtaaagctcttttcttctgtgccctcatcataatcagtctcaatgctctgttcatacccatctagggttttttcctagcatgcatctcaaactcttccagcctctgcccattacccagttccaaagccatgtccccattttaggtatgtgttgcagcagcaccccaaatataacagagacaagcagagattttgagttggcaggcgaggtaagggagtggatggagaattactaagaatgtgattaggtatctaggaggagaagcatgtctaagtagtaagggcggagaggatgctccataaatgggctcagcaggattcttggctaaaaccgagccaacgacaaggcctagtagagaagaggattcagaggagactaaagtttcatcaaggagacagtccttgtgaatttacctgtgtacatttttgatatttagtgtatctcccactatgaagtaagctccattaggagagaacctgttaacttttgctcaccattttattcccaacacctagaacagtgccaaagtacgtggcatgtgctcaataagcatctgtttattaaatcattgacagcagattttgagtgtaattcctctgcttcaatttccttccccaatgtctctatcaaacataagccactgggtttttttttttaggggttggttgaagtccccccttctcaacaaatccttctctgatagtttcagttccaaatgtatcccatttttctgtacttcagtacgtagttactgcctgtaccatttatcagggacttaatcatattctttcttatttcttaatgaattcagctgtgtgactcccagaacaactaaattatgtgcccttagagagtggggaccttgtcagaagccttttgttttgcctttagcacagagtatgttgctattgcctggtagatgctcagcaaatatctccaaacgagtaagttaattcattagttaatacaattaatgcttagccctaaagtggtttacaattaataagaaacacagaataaatacttgtaattttacttacaaaaataacatttatctaggtaagtaaaattctcttcaaagaaaataatctggaagatgatagtgctgttgttaaagtgtattcattactcacattctccttagaatcttcttttggcataatgtatgcctgtttttttgtcatatttccagatactatctgtatatctctacttgtcacatagtagctatgatctgaacaggcaattggttctgctcacttactattatcagaaagactggctcaagatcagctgctcctttttggcacttgcccttcaaaatttaattggcttagatccaacgattctatattatgggtcaaatcactccatcacattgtgatacatttggcaatcagtgtatatcagcgggttcatctagaaactacattacttactattagccatcctatgggaacttttggagatattttcattgctctgatagatgattgatatcacttgctttggaatttttctgggatgaaattatagtagtcatgcttaatgtgttagaatatggggacatgattacttattctccccgttttagaagcactgccaaacctgcccccctctcagatggtaaccaaaacatttagaccattctgggttggtaacatgaatgacctgcgttccaggggtttgtcagaagcatatcttgtataattctattgttccactctcatttaaagtcttgttgcagaaagttatttatccatgttatataattaatccactatttgaattaaactgaaaccaccgcatgttttagcttgatatcaagtgatttttattgcaatcccctttggtattgtaacccaattcattggaagccaatggcaaaagaaacagatgacaaaatttctctttgatattggaagatattggcgagggcagtgtccactgggactgtcactgagtgtgagcttgctgttttgaagggaatggcattcactatcccacatcatgggcacagcactcatggtcacttggatcttgccccttgtatgaaagagttaatggtggcttatggaaatgatgtaatttgctaaattaactaagttagaggcaaaggtgaaactacgtgacttcgcaatccgtgcttttaagagtcaatggaaaaccatgaagttttctgtctcagtacttagcaaagccgtggttctcccatgtaaaaggttcatggttattttgtgtactacctgcctacagtaagtaatagtactctttctcttttgttaataatgcaaagtcaaatgtgccatccactgtcaacattaatataagacttttcacatggattttgatatgtacttctatgcagttgtattttatttctcacccttaccttcttattacacactttttctcatatatttattttatcgtgctacacagtggatactttggcaagctgtcacaaatacaatttgataattacagttcacacattttactctgctataccatctcctaaccgtctagtaagagagctgagtgcccgttttacagatgagggctttgaagtttgggtagtgtgatcctatgactgctcagctagccagtgcgggaaagagcctgtaagcatcagcatttgctgtcaagctcgatcatacctctacagggttctagtcaagagcagcatcttccaaatactgttctctggcacgctggcatgttagatatattaatagatgctcctaaatgttaacttaaaaatagtctgtagtcatacgtgttggctaaatatctctctcgggttgcgacagaaaattaatatgttaaactctgtgaagcagagcaggttaaattgatgttttataagtttacttggtccagcacatatttttcttttcattcaaaatgcttattcattgagtctacatggacataaagatgggaacagtagaccctggggacttctagaagggggatggagggaagggcaaaggctgaagaaccccctattaggttctaggctcactacctggtgactgggtcatttgtgctccaaacctcagcatcgcacagtatacccatctaacaaacctaggcaggtagcccctacacctaaaataatacttaaaattatacaatgaaagaaaatgcttattaacatcttcttcaaaactgctatttaaaaaaatcaacttggaaaatgttggtaaatataacgataatgttgaaagagcctaagcagcaattcagtcctagcctcagctctcactaaccagcagcgtgaccttcattcagtcacttaacctctttgggtcttaagttcgtcgtctgttaaattataggtttgaactcgatgatctcaaatgctcctctcagtgctaagatgtttgatgtttgactctaagtgcaatctcatctcaggcaggctcaagtgtatacttaggttctaagggttaatgtagcatccagaagaattttgatttgagaataagctcataacaaggaaggaaatcttgccacttgagacaacatgaatgaacctggagaatatgctaagcaaaataagccagacacagaaacacaagtaccgcacgatcttacttatatgtagaatcttaaaaagtcaaattcataaaagcagagtagaacagtggttaccagtggctgcgagtgtagggggatggggagatactggtcaaagggtacaaactttcagttccaatatgagcagcttctggggacctaaggtacagcacgggtggtgatgaatgtgttccttaatttgattgtgcagtcattacaccatgcattacaccatgcattacatcaaatcatcacgttgtacaccttgaatatattcaatctttatctgccaactatttcatttatttaagcagaattttcatctacaggaagaagatggggtaaagaggaggacatttatcagacaatacattgactttttattgcaaactagaaattgaacttatctgcatttcctttcttatttatattattctccaagttgtaggaagctcagagaaaaaaattgaagacataaaaaagttgatgtcccttgcaaagttgaaaaaaaaatcacatcacattttatgttaggcttttaaaatgggggaaaataattacacctcaaattgagaacatcacttgactgtaatatcccttttcaagcagattctactaattccagatttagaaaatgaaaatgtgttcatagaaaccatcagagcaaggcagatggaataaggtatttgaaaaatcttaaagctgtgcttgaattatcacctttggatctgcatatttgaaatatatgattaaaaggctttctctagcactgttttacaccatcttctgaaatgcacagagagggatcattaactgtcctctattttctctgaggatggaataaagcaaagaaggatttcaactgcagcaggaaggagccgagttagatattagatgaaccgacaggttaattaaacaattcaactagcttccagagatgacttggctactgcagatttaacatacgcatgatctcctagattgccttctacttttataattcattctcagatcagatatacactagaacccaagaagtctctcttctcttctagttctttccaacctagaatgcctatttagaccttcgtcaaaattccgacttgtctttgaggtgcacatgtacttttaccttcttttggtctgtaagatctttaattcatgtaacattctgttacatagcactcctttctcatcaataacatatgccttggtactttattgtatgagaatataaattacattcatcaggctacaccactgccttcttagttaattgctaggtaaggtttgtcttgccaaatgcattgaaagctctttcaaatcaattcaacaaatagtttttgctctatgtgctgggtaccaaagggatcctctttaaagataaagaaaacaccaccattgatctcaaagagcttagtgtctggtgtggggaatggcatgcacacagctaattaaaacacagagctgtgtgtaacatggctgtggcagagacagaaaggaggtattgtgtatggaaggtaatgaggggaaacttcatgaaagagaagcgtttgaacacagggtgtgaactctgtcaatcccaggcagatctgtagttctactgtggagccccatgtctggcacatagtaggcagctactcatgaaatgcactgggttgtatgaatcagtgaagacataaatatatttttccaggcaaaggcatgaaggaagtgggatctaaatggaaggatgaacttcaacattaaataaaggagtccatttagctggattttacataaacggaaagtgaaggagataaacttagaaaagtaagtaggaatgagatatttcagtccttgagtgacataatacatggtttaatctttatttggtaggtaatgaaagcagagtcggactttgaacagatgaacaatatggtggaggcttttgatgtcagtatttttatatcatggttcttataataaatctatattgtatggtagatgctcactcatgcttgaatttgagtttgagttctaagtaaaaaaaaatggcaaggttttaaatagaaatgatgggagttacattataaaaaccacagatataacaggtgatctcatactcgcagtgcagaaggacatggagaccccatgaggctgagcaagagagctgggcttggggccagacctctctgatcaggccaggccctatctgtccgactgcctggagcgccccaatacgcctcccagtgatgtgctgcctgaccccagattggcttccaagccaagccgaatatccttcaatttcattttaaaggaggaagtgctttgttttcaaacttagacaccctcaagagatgcctgcgtcaatatttgcctccctggtatgaagttttctttgtggaagctgaatctctcagctgaagcttaacacctctttctgggaaactaaacaacgaaacttgaatttgaaaattgaccttcatcggatgttaattagccttcttaaaacattgatggttgagaatgataagaaccaaatgatgtttatggagtgcgcagggtgtgcaaggccctgtgcaggtgtctggggggtgggctttggagaactgccaaggtatgaatgctggttctgccacttactagttgtttgttcctggaggagctattaccattagttactttcctaatttataaaatgaaaccaataaggcctgccctacagatcttttctgtgggtaggtacaatgcacaatacagtctccgcttgccagttaaaaaaaaaatgtcaagagaggtctctgctctcaaagaatttgccatctagttagggagacgaggcgggagcatgcaaaaagtcaattagtaacaaaggattgaaataacaattccagacaataacagaaaagatgtcacaaggctgtatatgattaattgccaaatgaatttttcacacagtaagaattcaaagagagaacatttaggattgggacatctaccaagttcatcatcccgtcattccgcaaccttccgtgcagcgaatccttcctgtcctcgcgctcacagcccatgtgggatcctgggctggtctggagggcatctggcattccacatgggcctcccgttattggagatgtggtctctccccagtggcgaggccgtgttccaaaggaatatcctgcagaatactccaaacccaagataactgttccagtatgaatggagtgccaggtctctttccattgcaagtggcgaacatgcaactgaatccagctttgagatgtggatttatccactcaatggctggaacaatccaggtgcaattcctgggagcaggcacgctggatgcatgggccgagccttccggggccctgcctggcccctctctggcccttcccaggctggggtggggtggggttggctccctcaggccagccctctccgcagccagcgacccgagacaggggcaccagtatccgggactcaggctggggcagtgggagcacacacgcatgcggtcgcggggcctcggagaggggcagctcagaggggtcgggtctgggagtgagaccacagcgcgcgcccggctcaggcaaagcccgcggctcccgctcccgccgctcagtgcacccgcgggaaaggcagcaaagcgagcggcgccccagtgactgtgcggcccgctcggcggggtgtgtgcgtgtgtgtgtgtgcgtgtgtgtgcgtggtgtgtgtgatgtgagtgtggtgcgcacacgggtgccgtcggggcgcaggcggtgtttccgggcgggtgccctgtggctccaccaggcagtggctgggctcggctggggcgtccgccgcgggctccggcgctgacgggcgccctctggcggccgcgcggacgaggtgcggtcccggcgaggcactggcgcgacgtccgccccggcccctggcgcccccttgcggcggtctccgggcagcgcgtctgcctgggacgaggtcggctcggaggggcccccggcaccctgcaggctggcgacctctccgggttggtgggccccgcccgggccgcgaggaggcccaggcgccggggcggggaggccgcgcatggggtccgcagcggcgggacgggccgcgggggagaagcggtctccagaggggccttgagcccctcgcccggcttcgtagctgacagggccgtgccgtgccgagggctgtgccactcggcgcagaacggggtggggcgggggtagtaagaggggaaagggggatgggcgagggggaggagaggatgaggaggagaggaggggaagggggatgggcgagggggaggagaggatgaggaggggaggaggggagggtggcaggtggggaagggaagaggggagcgtggggaggggaggatggggaggatggggaggaggggaagagaaaggatggggaggggggaggatagggaggagaggaggggtgcgggggaggggaagaggggagggtggggaggggacggcgcagcgggtcctctgccttgggcagacccggccttccctttgccccagccgggtggagcccggctcgcctacccaaggccccaagactccagcgcgggagctggtggcttccaggggctcccggagtggcccaggaccccgggtcgtgcggacgcggggctcctctagaggctggaggggagccgaggcggaggcccaggcccgggcttgtcctgcccttggcctggggaggggtccctgagccgggagctgctctgggcccgggtcacccccggccgtctcagggctcttagcagcaggaatggcgccagtaaagaacgcgcgctagaaggaaacggcaggactctgggcacactcgggagcagggacagaacttcccggggctgctgagggacgcctcccaggggaccgcgctcccgttgggatgcaagggacagatgcctggaagagaaagggcctcacagcacacgctggcggctgaaggctgctgagaagggtgggggctgtatgcggagaggggcggggaggggcgctgccagcgcttcacctgccattcgaacggcgggggctggatgtttactgtggcctcagtttctccttctagaaggagattctggattgggtgatgagtaccattgatgtaccccacaaagcctccccctggggttaagaggaggtgcttaggtccagtagcaggatccccctagagcaggagtgcatttaatacactattgggcttatccaaagggagaatgtgatagaagcctccgtctgtcatctcaagaagagaagtcaatctactccagctcaggatgtggaaaacaaaagacgagctgtgaacaccaaatacagtcctgtgtaagagcgcttcattcattcgctcagccacttgcgaattccttacatattcgttgagcttgtgctttgtagcacacactgggttacgaattgggaaagcagagaatcatcagcctcagttcctaagttgcggaatctgtgatctagtggaggaggcgttcacttaaatgatcagcaggatgccgcatcctcagagatgtctgctaggtggtaccaacggggctgacatcccaaaggaaacggagaattaactgttcaaagagccctaaccctccagatggaagcaccaagtcctgtaaatataagggatgggtatacctcccctctccaccagggacatcagatgcgcctgtcaccctgaagtcaggagcacactgggatgctgcaggagtgtcctacaaggaatagctacattgattatctcggcttcgggtccttccaattctaacacttccaatttatgtttgtggatataatgttgaaactggtcctctcaccaaaagctaataaggcctggcggtaagcccctttccccaccatgcacgcttcacccccactcttccactcacctgtgtccccactagactccgagacccatgaacagtcgtgttctgcaccgatatctcagcctccagaacaggcttcagcatgcagaaggcctaggtgagtaaatcatgaatgaatgaagaggtgaacaaacagatgcctgcaaggtgtttaaaggatggaagcaataaaaaccattgagctccttcatagcgacaagagcttttatactgattctctctccagcttcaaggtgctaaatggctcctcaatagaatgagtgaaaataaacgggcacagtgggtttgggtgttttgctgatttgagggcagggaggaacttgtttaatgaaatgtgtgaatatggcaccccagacctgggggtgtcctctcaactaaccgtcttgtctcaggcagcattatacctaaaacattccacagatgagactaaagcctattttaggaaaaaaaaaaaaaaaaaaaacatttgattaccaaagtgggaatgttttctcacggtgccgctgcaagtatggaatcgttggcattctacttcatcttccctcttagggccttcctactcaccgtgtgggccacacaccggccgcagtagtgtcatgagagcttgttgaaaatcaaaagttccaggcatcatcccagacctaccaaagctgaacccacattctcacaagaccgcatgggtgatgaggggacacactggagtctgagagttaccatcctacagtcccgcaggttgattccaggtcaggtctatacatccggccatctgcatctggctgggttgctgtagctcttgtggattggccagtagttctggctctgttgtggatgggtagggtgagtggggaccctattcatagaccataaggagttttcttctctggtcattgctctgttcccaactctctacacacttctgctaaaatgctcctccttatgttgaattaattctgtaaaactgtttttctaacatggttgaagttcaaaaggcattcccaatgagctgctttgtgaaaagggagagtgatgcctatcttccatccccttggacgggcacctcagcatgtctctggcatcattatggagcaaaaggcagagcctgcagcaggatggagaaggttgggggatgcgggaggtggacaggaccttggggaacatataggtccttcctctcaccttacaacaggcaggcggaagtggagggggtggtgaatttgtgaattcacaattcacaaattgtgaaattgtgaatttgtgaggtcacacggtgagctggtgcaagagatgaaatgggaacctcccgaggttcttacagtgggtggccacgcctggctgtgcactttgcagggtgtcacagtcatttttttgtcaccccagaacaagtgtagagtactcgggcagatttgttttagccattttttagcctcttttcatatagagatttttgatttatctgaaaggaaatcagatctgagatcataagttgaatccacatatatgaaaatcaaatgaatgcttataaatcatctgaagcaccatctactccagctgcccatcaaaaatgtgggtccccctgtgacattcctgcatggtcaatgcctggccttgagcacctccggaaaggggagattattcagatgggataaccctgctgtgaggctgtgtgctccatggatccattcttgccttctgttcagttgaaatacgcctctcgttacttacactagcttaaaatgcgtatcaaaagtacaagcaatttcatatcaaacatgcttgccaacggcaaatgtcttcatccagagagagccaggggcccggagatcaattcaggcgggcgtgtatgtggaaaactgggtgagacacggcaggaactgggtgggaggaaggaatattggggtggggatgagcttggatcaacaagagggagaactaacgtggcacatctggggaatgtaaggattccagtaaaaaagattcacgtggcctcggaagtctctaaaatctgtcgtttataacccctagtaggtgggtgctttgtatttctcaagcagtaaaagaatagcatagcataaggagtgtatgaaggtggtagttgggggcggtggagagatttctgggtttacgtcttaagtttggagtgacagccaagattcttaaaatacacgggcacggagcgccctcttgtgcctgatcggagccagtgccgctctgtaaaagcgagcattgtggcgctcagggagctgcccgtggtgcatcccagaaccttagaccagaggtgatttccagggttgtctgcgccctcctcactggagggatgagggtcaagggcctagacagcaggagtcattgagcaggggtagaagccaggtctctaaacttcaaaagcgtgttgccttttatattattatttccttttcactccggcacaggctaatgactgaaacatattcctttctttgtcaccggtttacacaaggacctgctcactccattgctcattttcttttatcctcagtctctgctgtagtccctgcacacatgcagtgtgtctgtcgtgttgccgtgtttgtgtgtccagtgtggaaagcgtgtagatgttcagctgttttaatggagcaatgtaggtgatactgtgttgggtgtctccttgttcccgtgttttcactcagccccatgtttatcagatcgtccgggcggctgcacgcatcttgagttcattgcgcacagccaccgtggcgtgctcggtgcgtccacacccctgcttggtgtgcacctcaagtatgtctgtccggtccccttctctacacaacactgcagcagacatctttgcagattcccacttcagtacgccgataatacctgggggctgagatggactcagaagtgaaattgctaggtcatagcaatgtaatttactcagtctaagagttaccagattcctccctagaatcgcggcttccataaggtttctcatattttctgtatcccctccaactcttgccattatccagctttccagtttttcccagcaaattatgtgtgaagtgcttgtattccacattctgattctttcagtctgtatttatctgagtattttttttctgtggccggtagatgggcatttgcattgtatgtttaaattgtctgtttgcatcttttgcctatattccaataggagtcttttctttttcttattgatttgaagattttctttgtagaaacaaagtattcatcccttggtgtttttatgcattgcaaatgtcttctcccaatgagttgactgttaacatatttcttgtgcttccttcatttaatagaaattcttaattctgtcatcctcagtcatcatttttccttgtgctttttgcttttgaagttatttatagtaattaaaaaaattcttaccgagttctagttcacaaagacaagctctgacatttccctttattgattttataatttcacttttcacattacagtcttaaaattgtatagaatccagttttacaagcgtcattaggtagggatcttgctttattttactcttgatttcagattgctttccacttcctactcagaaaggtatcacgccgagcccacggggaaaatgagggcagggctggaaagcttgaacctgactccgtgtgatgagctccaagtcacggggcaatctcagtacttgttcctcagcttgatggggcacagacctctccagattcccttggccaaacccagccctcctgatatccaggcagggttgagttctaaatgagctcacagagccataagcaaagctcagaagtccacctcatctgatttccctagcatcactctagagaaccgcaacccagaaagagtgatactctctgttgcagaattccctcaaggacaaggcctcggccacctgcagtaggtagtctagatggggggcagcaaaataagactgggtgctacctcctgccccaccgccaaccatcactaaccgatcacaaagtggtcacccacactagctctactagaaatcaatcaactgcaatctttttgtctgggccttcacctgcttggcagagaagaaccagttgagatgagtcttttggaatacagaagattcctagtggggtcaggaggtgcatgtttcacgctgctccatcaccagcctgctgaccagctggagagtcacttagcttctctgagcttccgcatcttcatgatgatgatgatgatgatgacaatgatgaggctgatgatggcttgcattcacacatgattctatgcggggggtggggtgtctcatttgagacttgtgacagtgctctgaggagtctttctgtgttacagtggaggaagccagccaaaggggagaatcaagtctggaccgccgcttgcgtttgcatgacgttcacagccaattctggcctagaattctacagtcttgtataacatctcctcttgaagccttactttcctcacatcttaaatggaaccccatatgcagggacatttttctttgcaggtggaagtgggtggtctgagtgaaccagtgcagaatggaggcttacagtggaggaatgccaacaattcatcccagacatcacctgcctctcaaaacctgaggaattcagctagaaaaatgtttggaatagggaagggggacaaactatttagaaaagttaatatagaattagacagaagtagccaatttgttttccaaaggtatgcatgcattgccttgaaagcgtgtctacaaaatattaagtaaatgaagtacaaaataatacatatcccaccaccctattgtatgaaaaaaacaaaaaagtgtacagatttttatatatgtttatataaaaaataacaaaccaagagtaaattatggaagaacatacagcgtctttctaaaattctaaaaattagtaataccaatgtacatgggagagggagagactatggattttacattagatattttatatcctttaagtcatcccaaataacaggtattaggtttatcattcaaataactgaataaaaaggaaaaaaatacaggctgactggaatttgggtggaggtttgattgctgcagattccttcttgtttccacaccgacttaggaatccaagagcccaggctttggcaggaccaaggtcccctaggcctgggtctcctgctctctgtgtgcagctccccaagttaaagagtgcctcagagatgggggaagtgggagaatcaggtgtcctgggctggctcggaagaatttcttcctcctgattaaattgtcagatctctccccagagtagatggatcgtgctttttcctggccaagacttttcttggggggccaggcgtgagaggcatcactgccagtataactgtccctgtgtgcacctggcagtgtccggcttcagagcagagcccctgcagcaaagcatcagtcagtgtcgaactgcttcccggcagcgtccccaccgctcatcccccagagcccttgggaagtggcctcctttctctagaaagctgtcagaagaatgcagagattctcctgctgcagcaccttgtcccagggaaaggcctcattgaggagaagcctctgagacccagcacgctctgtcctggttttgtctttggagaaacatggctcccgtttggcctcataatgaatgaaaggctggtgagcacatagcaggttgccaaaccattcctgacaatgccatagaaatattgatcctacagccacctctgatatctgtcagtgtcaatattttgcactcttgcagctactttaagaaagggggtatggggaggaggtgagccttgtctactactcagtctgtgacaaaatgcagctacgctgacagggcagggtggggacgcgtgagaggctgacgtccactgcacgcacactttccttctttctgctctctgccctcctgtcccccagtacttgccctaggtgccacttcctggtgagctgaggatgcctgcgagaaagtatgatggtggacagacaggggtgggcgtcattctgtgcatggttatttaactttgcttctcattacgggcaacttttgaaatggggctgagagatgtggcttctgatagctctgtttccacctatagcagcattttaaagcttagccgtctgtgtaacaaagggattagataatgacgcatgattatggagagggctggatttaatgttctcatcatatttttgcaagagtagataaaaaattatattaacaagcagaatatcctgctgctcacgacctgtgaaccaaagcttcacataggatcctgggggcaagagccccgactagctggtgggcatcctttactctccccaggccatggctaccatcctcctggaagccaacctcaaggacctctgaagtctggcctggaaagtctgcataggctcccaccatgggctaagagtttatactttcttctccctctaaagggagctggaacacacagcaacaaattgtaatcaactaataccagagtatgcttacatagaggtactaaaactcttaggctcctggcagccaaagtaaggagagggaccactgctttactagagcaagaggaacaaaatttcttacttgggaaggactttagaagtcttctggtccagctcatatatgatacacaaacctcagatataatatctgaatccagatgtcagggaagaaaagtagcccttttacatggtggttttagaaaaataaaagattatcatttgaaatgagctctagaaagatatagatgtttcaagtagatttacatattgaaagaaagaaatgtggattgacttattctgtatggccccaagggctctgtaaagattgaacgagctatctcggcaaataatgaatgagattcccattactggaggcattcatgtagagaatggatggcgtggaatggaagatggattaatattgaagaatatacgttctggaataagtcaaactggtttccatcccagggtgtgctatttaccacttctgtgaccttgggccagtattctaagcctttttctttattcacaaacaagtatgataatttattgctcttcttttaaggggtcttgtgagttttcagtgagctaacatatataaagtacatagccgtgtatctgggtcaataaatagtaactattcattgcatttgttcataatcacttggcaaaagcattgttgaaggttaggatgtcaagaccagcagatatttcatattcctggcaacacggtgacttcgcatttgctacctatttactgagagcctgtcatgtggcaggcacaggtctgcacgtggagaactcaggggtaaatggagctgatgtaactcttacccccaaggagcctgcagtctagtttctatggctggcattgccaatggcaggacaagttctgacttcagctttggggcagctcattagaatggtgctgagaactgccctcagctccctgtcctgggtttccgtggttggagtcctgctaggagagccctttggcactgctcctcttcagtcccgctggtccatggaaatccaccattcccagcacctgctgtgcccttactcacaccagttctgtcctcctttcattccagccaatgctgccatggtgagctcctcgcaggtgcaaaccgagagcccctcacctgggctgcaccttgcttttctgccccagggcttgactggtgcctgaaggaaacttgggagcgctcaggtgttaaccagagtctgagatcgttaagaacccatgactaatgggggaagcagaaatggagggtgtgttcttccccctccgtccctcaggcaggtaattctgaggtgtatcgtacctggttcctcagaaggctgttcaggactgagcctcacttgaacctcagcttcgctatggtgactcactcaagagctctctctgtgctggcttcctccttccaggtttcaccgtccctttctctcacaccagtcacccagagttgcttccaaaataatctgtcttcacaccaacccttgtctcaggcaatgttctcctggctgagatgtgctgtcccagtaaaaccagtgtcacaagacttagtcaatgcctctactaaatctctgtcgctcactcttgagtacttacagtccccttgtgtttgatggagagatgtgcagtggtgcacaaatccaagcccaccaggacacctgtccctggttactcagcactcactgtctgtcccctccctagaccagcactgcactcatagtcaaccgaactcctctccaatacgtagcgcactctccttctctaactggtgattatggaaaagtgccaaaagacgtttcatacttgatagacttagtccacatctggtcatcaagccgtccctagaggcgagtaaggcaggtctgaagatgtatttccctttgggtgttatcccacatgtatgagtcagagattcattcatttgttttagttaaccatatctagattttctattttctctttctaactgcttttactcctcctacaacttacaggggaattatgctgtcgttgccttttgagttattttaaatgtttagtctcacttattttctcaaatgcaaagttctttaatagcattttgagtgattgtcacagtaggtttatttttaaattgagatataattcacatgccataaaattcatcattttgaaacatgcaatttagtagtttttagtatattcccaaggttatgcacccatcgcccctatttaattctagaatattttcatggccattaaagaaaccagtactcattagcggtctctccccatcccaccctccagcaggtggtttttaacttcccatcgcataacttcatgtggcccgagtctgagtacggtaaacaagtgcacgatgatcctttgggaatcacttaggagcaattggtggtacggggccgtcctgcacacgcagtcctgacttcactaccgctaactccgtgactctgggcaagcattttatcctttctgagcccagttcacatttatacaataggaggattgggcgatatcaggaagatttgctcttggatttgcaggattttaggaataaaacacaggaggcccatgagtgctcagtactcaaaatttggaatgaatgtttgtagctgcagttttgtttgtttgtttgtttttggagaagacaccaaatatttagctaaactataaaagggcctaaaactctctccatcacttttaaaaatgaacaataggccagacaagaaagtacttgttccacttctaacctctcagtatgatctacatttacatttgggaaaattgggtttctgggagtgacttgcccacatcattcgacaggcagtgctagcacagagccatgtgtctgactcctgggccagtgatttttccttaagcccctgctattcctttgacaaaatttgcactttggaatcagaaaaatcttcaagactcatttatacatctaaatatacaactatgtctcaaacataaaaaaccactcaatatattgtactttttacatcattccacttgtgagaaagggtctcatctatatgttttacacaatcacccccaccacacacccaaatgttgcaaaacccttttgctgagctagtaagaaacacacacacacatacacacacagacacggatgtcatttctatgctggtttccttgaagcacagcagaggcttcgcctgtccacatctatctcactgagcttggatagggcaaagccatcatctttgatgagctgcctgtcttagccagtacctgcctcaccccaacctagtatattttattttaatagatgagacatatctggttatatttaagaacatcctctcattggagcctctaagaacgtaccctgcagggagatcacattctctctcccaagctccctctgtaggtgaacatccagagtcatctcagtggctgggaaaggccttgcctggcttgctggagaaggatgtgtcctgtgtctcagaagactgaaggctgccactaagtttgcagaaacatatttgagctcagggtatgaactctcctgcccaggtgtggtcctgacagagtccgaggaaccaacatcgcttgacccccagcccctgctcctttgtctttatccctggtacaattttcattcatttcagctgcctgcccagaccacccagccagtatgaacccaggcaatgggaactaattataatattagcttagacacaacataattatgaagaaaactgctaataaacaacttggatttatgcattccaaaaatcatctaaatagtttcagttgcaccttctttggaattagccacaccgttgcgttacctctcttcataggctctgaaagtagggagtgagggcttgtagccagtccccttcgtccataggcaatagaattgtgggcccgcctctggccatcacatccctgggtggaagtcagcattcactttctcccaggcgatgctgggtagagattatgaaatcttgagcctaaatggaccagggtgggagaatttaccaactagcagaagggccaagggggttccgggagctttagacagaacagggacaagcagtgaagcacagaaaattgacattggaagttgcctgtttgaaagacacgacagcctttgcttgctgcagagctaattattatgcaaatttatgctaataaactctgccttgcatgttgttgagaagctgccttttcccgttaacatagctgtaatgagaggtaaatttgtaatgcagatgcccgaggtaatatatcctaaatcactttatggtggaacggactctcttgccccacccgacacaaatgctaatttaaattagtttttgctttgcatatttattgaagctttatttattgttaatatgtactaaggacaccaactagacagcccccactacttgttagaagtggaatttagcagggagctggggattggcttttgctcatcaggagatcctagagttttttcttctcccacctagagccacagcatcagcttggatggtgccagaatcgttcatgtgtccccctcctcctctgagctggcctcaaattaggctcggcaatgaaaaagcaattctatcatgataattattatatggcgtttctaagagttaatggtctttgtcacctctgcctttgtgtttgtgataccacccaggcttgcagaaacacgcccaggaaacgggagtgctgttgagacaatgccatttgtccactttggaaacttgtgcacacacacatgctctcacacactcctatacatgttttagggcacacatgtagcttcaagccccatttgcattcacatttgtgtagtcgcacacacacgtttgatagtgtcttacacatcattcaggggtgtcttcattcaggttcgaacacacacaaattgccactcgcccctgcaccccagctatggtcttgtgtgtaactgcaactcttctgtgaataggagagcttggcacttggattggaaaagttcttccaagcaattctgagatgaaccttcgaaaacagcactaaaacatgagtaattttgtttctagtttgcattctgtcacttaaataaataaatataaataagtgcctaccatgtatcaggcataatgttaagaattttcttgcatggtttcatggtttcattttcacttataaatagttcagtttaggtctatattattatccccattttggagatgggaagactgaggctctgcaagtttaaataacttactcaaggttaatccacttattccacatagcaagtaaaattcaagcgttctttttactacaccgttgcttcttcactaatgtctcagtaaatctgaggttgagtttcttctacaatttaagatgttagatctgatccatctagctccaaattatgatgttctctgataatgtaagtaactctctcctgattctgtttgcctctttgcatctctcactgtgaactaagtttaagctagtcacttgctttaggattttcgaccgacgccacctacctctttggtatgtgtaggtttctcctagggcaccttgacccttaaccattttgtctgacactagtatggaaaaaatgaatctgtgaagaactggggctaacccaaccaaataagatgtcaagcagatgtgctaacttatgcatacacatattcagggaatgccaaaatatccgtctgctgaaaaatatctccagcatttatgtgtcaaggacctagagttttcctcattagtataactcctttgaacccagttaccctgacaggccctcctgtgaacatgtaaattcacattacatgaagcaacatatcaactgtttgtgccagctaattctcgagcatgtgttttgtgcataccagaacctaaacaggggagcgatgagagaacagagcacatgaattttgatgaagaatgtactggaagaagggcagcgtccgcactgctcacaagacaggctgagagcaggccttcccctttaccatttgggcatagacctctgctggcagaaatctcccatatgtaaatgaaattctagtgaatgaggatgttcttctgatctattaaggaaaaaaagcagagtttaagggcttcttcatctccccatggccacacccactgtgccccaattctaagctctattcccaataaaccagaatgcctgggattctacttcagaagggcagagttttggcttaaggaaataagctaggctgtgatactgagcctggaataaaaataccatctgtcagtatcaatctttgctgctttaaaataaatacgtttattagatcaattttggttggaacagtgtgctgagaagaggcctaaaaagaagcatataaataaatgcattattattgttaaaatttaaaataaaacatgaaaatacttcaagtatagagaagaaaatagcaatgatccataactgcgcccccaaagataaccatccttcagacctccctagataccatggggctgccttgctaaaactttgcacaaatatatgataagcattttccccagcggaggtaattttgaaagggaggttggacagcattttactgtgggagtaggcagacctgggcatgagccatgtcagggttgagggatgacatccctgatcctggggggagaggcgatggcataggaagggccagtgaaagaggcaacaagaagcttcaagacactaacttcatccacctggccactttgcccaggtggactttgggcatcaggaagtgttttatgccactgagtgaagacatcttctcccattggatgtgcttatgccttggtaaaataagaaagccaggctagtgcagctctaaagttcccttcagcctatggtttgttccccttgaaggaggagttgatgttctgcttgccctgagtcctctcaaggattcagccagggttgagcatgagctccctgattcagaagttcctcatttcaacccccagaggagtcccacagagcgaatattctctgttctagcacgctgagtagtgccagtggctgctttcatattgaagagtgattggcagtgggaggagcctggagtctggatttggaagaccctattcaaatccaagccacaccctttactcactgcagatctccgagcaaatgacagtgacttcatctcctagagcctcagtttcttcatctggaaaatggcactaatcacacatcttcaaaagattgttgtgagaatgtgtggctgagtatggaagtgctctgcaaacttaagcacgttatgccataagggagcaacagggaaagagtcagaactcagggattccttcgcaccagttttcatggcttattgttacttttctattttatttttatagtggttttacctctagataactttcacaggtattatctcaacacaacttcaccggcctggtgtggtggctcacatctgtaatcccaacaccttgggaggctgaggcgggtgaatcatctgaggtcaggagttcgagaccagcatggccaacattgtgaaaccctatctccactaaaaatacaaaaaaatctggtgggtatggtggcgcatgcctgtaatcccagttacttgagaggctgaggcaggagaatggtttgaacccaggaggcggatgtcacagtaagccgagatcacatcactgcactccagcctgggcaacagagtgagtctccatctcaaaaaacaaaacaaaacaaaaacaaacaacaaacaacaacttcgcagggacatgggagacagaacacgaggtggcagcctcatatgacagatgatttgagcctcagggtcttccaatgacttgcaccaggacatagaatgacttagttgttgctggataccgtagtcagaactgggaattggatttcgcctggcataataaaaatattgcaggacccaagtcaggaccagagtttggttccttgaactaacaaggaacctccttcaagtcctagtactctccctagactttggcaacctcttctatgaaaggggaggttggaggagagggcgcagtgagactggcatttttttaaaggcgtcttcagcattgctggtccattactctgagaggtgaagtaatgtttctgcaattggggaagtggctgtggtttaaattcctagtctgttaactggttgtagagttggtttcctctgaaaggggagtggccattggcaggagtggacatgaggcaagccagggtcccactcccttaaccacccaggccatggtccctccttggcaggcagaggcgggcagggtgctgctggcctgagggtcctgggcaggcggctctgttctagcactctaaggagatcagatgttgcgggcaccaaggttctcaggcccacagaggatggcatttctcatgtcaggaggggatggacgaatgaagacgtgcgcactcccgggagggaggagagtcacaggaaagaggtgtggacaggcaggatggagcagcacgtgttgtatcgggattcagtagtgtgatgggtggagccgggagaggagggagcttcgggcaagggaacgttggcaggaagcgtgcgcagcagcaggagcctcgggtgcttgcgggtctgtgcacactctggccaaaatgacccaggtagtgtttcagctttaactctgcaggtgttcaagtcccatccagtgagtccaagtgaagcaccctgtccacacggaggagatatcccagggcaaggctgacagaaggcccttgaggtcccagttacgtgtctgggcagacaaatgtgagactgtggcaaaccagagagcactgccttgaggttggccgcgtgtgcccgctagagccaggtgtgtccactgtactgagggaaagaagcgatgcccttcctacacacgggcaatatcgtgtaacaacggcttgtttacagcccttgctgggctctggggcacatttgtctccaggcagcgccttggagacgacccatctccgaagcaagtctggctagggggcaggtgcctctgccctggagcacaggcagtggcggggtgtgcatctccaaccccgggggccacgtcatcggcaccccttctggagccatggctccttctgaccttgttcccttggtgggcatctgcacacgtggtttaaaagtgccctttccagggctgatcctgcccccggaggccccagtgaagcagcccagcccaggctcagcacagatggattttccaaggctctgggccgccttcctcctgcgggacttcatgctcgtccaggtccggctctctcgggggtcctggggcttcaagcaccagactgaaccgtttcctctgcaccgtgctttcctccgggtgaggccaccaggcaccttgtcagggacaccgtttcttccactcaccccaccctggcccctgacaggtcgcctctccctccttgttttatttttctcctcttctcatccagattaaacatgtactatgcttcatatcttgtatgtgtcctgtctacctggtggacgcaacgtaagctccgtgtcagggacctttgtattgttcaatgttgtatcgttagcacatgccaggcttccaggaaacgtttccaggaaatgaataaagccttcttaggtttactgccggcccgccccgcgccgggccgtgtggctgcggaggcagaggagacctcagccttcccttccctccaggctcgctaaagcctgagctcttcctgacacttcccctccggcccggcccggaagtcccattcccggatccttcaccgaggccagtcccacccggacaagaattcaggcagcacagtccccctcccggggcagtctaccgtggggaaagggcaagcacacaaggtggccctgcagcggcccctgaggacgccagcgacagtctctggtaggaccagctggccgtcccttctcccatttgaccctcctcctggtccgctgccacagatcaactgttgccacagctaccagggaaaggggtgtttgtccacgggaatgctccctgcggaggagctctgcccgggggcctcagccgggaaggcggccaggcgggttgcggtaccaggggctgcccagcgaggggagacaaagctccacaagtgagaacagaagctgtgccggcggcatcagttacccggcagcgtctgggaaccgcgctgggttgcgctggggtcggctagtgggccggcgttcctctccttccctccctcggctgggctccgctccacccctcactcagcctcctctggatcagcgccacctccttcctttggtcagcccccttcacctgcaataggccccaatacaaggggcttgaggaaacagttttgtgttttgttttgtggttaaagaaagaaagaaagaaagaaaattaaagccatatcttccagccctgtctgcaactgacacagtcaagtgatcaatcccggctgacagctagcccgtttcacaaaaacacccatgaaatcgttctcaattcaggaatggctttgaagatctagctggtattaataatcaccaaccggggctgggctcagtggctcacccctgtaatcccagcactttgggaggccaaggtgggtggatcacctgaggtcaggagttcaagaccagcctggctaacatggtgaaacttcgtctctactaaaaatacaaaaattaccaggacatggtggcgggcacctgtaatcccagctactcaggaggctgaggcaggagaatggcctgaatctgggaggcggaggttgtagtgagccaagatcaagccattgcactccagcctgggtgacaagagcaaaactccctccgaaaaaaaaaaccaacagctctgtaaatgaccttttctgaccatgagactgaataaaaccttgcggcagattaataggacccaaagtcatcattcacatcctataaaaataggttcgaaggcagccgcttcacagtctgaagtgcaggcacaccactgcagagcccacgaaatgtggctccctgggaccttttctaagagcacaacgtggctttcctcctttctgaccccatgggaggctgtctagtctgttgggtttaagaaggagacaggaggctggaaaaggcatccctgagggctagccgtggcccaggggaccagccctctggttgcttctctccgccgttgtatgacatgtgtctgttctcactcggagcctgtaccactctgggtaactcttatagactggagcccctagaaagagataggaagggacagaataggaactaaacttacactgcgaaggctggtctctggactgaccggtagaactcacagcacgtgctgagacaatgactggaatacaacgggaaaactccatgaccccaaagccccatgctggcccccggccatgggaggcactggacaggcacaaggaggatgcggctgtctttacagacagtggtgtcttgcagaggtacctcagatcagtccccagcgctgcagctgccggctggctgcatgcagcagtgctggagcaaggcagaaagccattcctagggaggctgctgtggagtacagcttggcaaggcagaggctcaggggcgggaacgatgcttgggtccagtgatcaggattgggatcaatgacagggttgctgaggcagccctaaaccccagctggaacaggagatggaagctgaactggcagcaagagtgggcagtggggtctccaaggatgccgctcaggcagtcttgggtgcggtgacgcattaaatctacaagcagggctcagaagatctcatctgtagggaaaggagggatgaagggttggaacctaagcagggtgcaacgttctgaaccaagacctttaccaaaatccttgacattaagctggaaactaatgttttatgagcaaggaggactcttgagcctcggttctattaaatgatatcatttgcaaattaaaaatgtttggaaaactactcagcagtatttgtcaatagtggtaacgccagtcagaattgaacagaaaaggctcgagaagacaccgattttgcctacatgcaggtggtaaaaggacctgagagatttaagataaggaagtgcagcggggattcatggacttcctttcactcgggtctgtccagtctggcagaggcaaggacaggtatctggggtgagaaatttagaatcacatttgcggtagagtctggtgttacgggtggagtctgatgcaagctgctcctgtgctttcctccctgacactgtggactctggaaacttgcagctttgagcataatggagattagcacaacatatacccttggaatgacacagagcttaggccaggctaacagtttcactaggaaaggtgtctttacacccagtgctaggaaatttattctaaaaccaaagttggtgtcaccttttgtagctaaacaagaccctatgcccccatccaatgggcttcctcaaaagtttccatgaaattctcaaacttttcagcccccacccccacctcaatttctgtttagtgtcccatttatgcatgcacttaagtgtgcttggatggaaaacaaacgaaatggaactgagggccctgtctaatctgacttgcggaaaagtttttgaaagaagagatgagaagatcccttttgcatagcacattaaaataaattatggagaacttctcccttccagctaaggaggtggtcaagatgagaggataaatctttaaaagaataatgttttcaaaatcaggttccttgccctcaatcctttgatgtatgagtgtaagactaggtaggacacgtggtgaaatatacatgagagctcagaagagaatagcagagtgaagaaaatattagtgtttacatcaaaactcaattggaacactcatttcaaggtgatagtttattatggtgaatgcaatttagtcccacaaggatatttcctttccatctccagggctcttcccatgcctgcagccccatccccacttcccacttcccttctccccatatccagatgtgaggaagcaaaacacatccactgcagaattagttctttgtgactgcaggctttgcagactgtaaaggaaaggaagaggaagaggtagaatcctttggagtctgccaatagttccccagctttttggagacgtagacagttttaaacagagaagaaattaacacaaaggattatcttcttgcagtcaaccaaaatgatcagcttcaaacaaaactgtcattcttcttgggtgtggtgatacactcttgtaatcctagcagtttgggaggctcaggcaggaggactgcttaaacccaggagttcaagaccagcctgagcaacatagggacactccccaacactaaaaataaacatgaaaataaaatcaaacaaaaactattatcctttttctttctttagctcgcatccctcttagacacactttaaggaaattcaactatagcaaaagttaagtggaggcaaaagtgatcttgttgaggggggcaaacttggaaaagcagtctctgcagccctggaggcaatgggcccactggctgatgcccacgtagggtttggtgagcctgtcatctctgcatgcagccagctgcccagtcagcagtgtttagccaggggctgctgtgtgcagcgttcccagccctccaggtgggcttgacttctaagttgctctaaggctttctcagcacccttcaggaaaacgtagaatcttgaatgaggcacctgccttcccaataagaggcctgttttctcacctggcaggtcctgtcatgcagccacagtaggagcagggacctggggagccaaggcctggtggctgcccctcccctccacaccctgcctgcacctactgtctctctctgaccttaggggtgactttgtcctgagcgtgggacagacaggtctgagcctagacctgcacgcaggcactgaggtgtgttttaagggtggagaactgtcttctacatgtgactatatgtaacagcatgcggctattgtgtcagatgcttatattttagaggttctgctggtacagtgctcagtgaaaatgaaggacagaaggaatcattcccttctaacagcttctgtgttctctctctttacaccagtagtaaatactcttcctgaattagaagcttagaagctgtgaatcctgaggggatggggagaaggaggtggagggggagggagagggagagggagaaggagagggagagggagagggagagggagaggagaataagatttggaagtgacctaaaaaatcctttattctaattccattttttgaagtttagtagcatgagatccagagaaaggaacggccttaaaatatctgatggaaagtttgtggcaaatctagaatttgaaatcctgtcttttgcctgaacatcaccacagatctcactagaaaagatggagtatcaacagctgtaaagataatagtagctgattaaagttttccaaaattctattctttacctgaaagctcacatttgaacactggcagtggatactgtgagttggtttccatgaaacaactgactaatttcattcccttttgagaaaatggctgccaagtacccaagtctaataataacacatcgtccatccttctttcaagcacatattgtgctccatgaaaacagtggctagctcagcttgcaactcaaacaaaagaatgttttcttgagacaatcatactacttggttgtgcagcagaagtgttctgggtgacccttccatctcaccaggcaaagttttaaaaatgtgtactcaagatttgaaatgtaataaaatcaagtgtttctttgtttaatgagggcattcttaagtgaaactggcgtttgggtttccctgcaagcgtgcggaggtgaagagtgcagtgactactcatgcaatgggctttgtgtgctggggttgtccatgcctgaggctcctgccatcttacccaccactgcttttgcaccatcagtgcaaatatcaacacagtgaagaaggcaaataatgtcctaatgttatcctgacaatagttctgacctccctaaaaggtcttgggcagtcttagagatttgtggatcacactctaagaaccaccagatgaaagaatccgcagatcctttgagtacaaaggctctgggaccagaaaccctttagatgtcttccttgagctttatctgtaagataagaaatgtcaaggtggcaatacaattctagataggtccctagtactggtctgtgctattactgccttgatctctgaatgataacacacaaaatcaatgttcggaccatggagtcagcctgctggaaatccacaaggtagtcctggaggaaaatttgatttgtttcaatgacaaaagataaaggtccttgcaaagttaccataagcctgaagcttagagcaaagtttccctggaattctcattttctggtttagttaccagcccagtggcggcagcctaggtcagtgaggcaagcttggaaccctccctgtgggcatcttcacacttcaggcttcatttttctcctgaagagcaagttacttctatctattgactgtaaagtcatcttgccagattatttttatccttaaaatacttaggttatgtatagactctcagcagttgatgttaagctgggcaaaaagtgtaaatgagactactggcctctactgggaggtgccgagaagcacagaggagaagcgaaaacccaggcgtggggagccgcgctcactacctgatttagccagcgtgctccgagatgcctggtccctccagagctgccctgatgggagcgggactagctgctttctgatactctaggctctaggaggtgcatcataaaacagaagtggacacagggagagagtccctaactggttgaggagtgggtggcatgctcgatgtgacacctgcccgccccatttatctgagctcttgctggaatccccatgtctctgtgtgtatcaggatgcaccccgcgtgcccccgccccagtctgcaaacatgcaaacacaccatgctctcctgcatctctgatgctgtttgtacctggaattgctctccttttgctactttctttctggggaacttcactcatcctttaaattccacgtcatgtgtcacctctcggtgatttctttcctgaagtctttacgcaaccaaggaagaatcaaacccttcctcctcctctatggtttgataactttaataatgctactttcaaacatttgtcacattatattatagttaattatttgcctggctttaccactcagtttaaaattctccaagagctttacaaatgtaaacaagctctgtgccaggtactggccaggagctggaaatacattgagtaaaacagacatagctctagccctggaggtattcctagtctagtgcggaaggcagataacgcactagtaaaaataaagtatattatgatgtgttctaaagaaaacagatgtacagggttagaaaagatagggtgtttaattaattttttatattgcaaacacctggaactttgtctctggcactgcaggagttcacacatttttgtctggtgcccctcattgtgcccctgagagtactaaggacttgagagggtcatgcagaaaacccaatggattgaacagaaggatgtgcaatgaagggacgatgacagaggtgtgggcagagttcacaggacgcatgtgatggtgactagcaacagtgggagtcatttctgtcctttgaaaaaagggcaaatagcagaccagttgctagggacaggggcaggctatagctttgcaagtggagctgcctgacaggagctgggtgataggacctcaaactctgtcctccacctcccatgtcctactggagaattctactggccacacccacccagaagcagaaggcaagggaagctggggtggtggtatctgcagacagcagagtctccaaggcacagagcaggacaggaagggcagagactggaactgggcaatcagtcgaagagccgccagctgacctgattaagggagtgggcaccaaatccagcagcctttggccttggacaattctgaatcaaaccccatgccaatctatgatctacattggccctcctggcaacagaggttatgtaagaggtattcccttagactctggagccaagtatttcacatgtgatcctacctacctacatctaaggaacagaaccctggtcaaataaaattaaagacaaaggataaaagagtaagcgacctagccaggcacagcagctcacgcctgtaatcccagcactttggaggccaaggcgggtggataacctgaggtcgggagttcgagaccagcctgaccaacatggagaaaccccgtctctactaaaaaatacaaaattagccaggtgtggtggtgcatgcctgtaatcccagctactcgggaggctgaggcaggagaatcacttgaacccggaaggcggaggttgtggtgagccaagattgcatcattgcactccagcctgggcaacaagagcaaaattccgtctcaaaataaataaattaaataaataagtaagccacctaatgtctctcccctcgaggagttgagaatctgtttcacaaagaaaacaatgtccatgaatgagattttacacttacggaaccatacatagtgattaaaaattaatagaaaaccatctgagtactgcacatgcttgagggcttggcagagattaaatgtgattagaatcaggctgaattaatcaggtaataacatcatagatgtaggataaagttcagttaaactgagtttggaggaatgttgcttcatctgtaaaaatagactttcttccccagacttttaattttggggaattctgaaataactagttaattttacagtagatttaaatgtgtcctggtttattttggttttcataaaaagagacattctctccacgattagagatttactgaatctggggagagatttagcattgatctggcttacctgattgatttccaattccccagagactctaagcaggtatggattcagatgtttatgaagctaatcattctgtattcatgttcactgagcctctcagtcactcatttttccttttagggccacacagtagtttatgaaattacaatcaattttacatcagatgtttaggaatgaccacggatgactttttattagatatcacatatagaataacaatcatttataaatcattctctgtccccctccatctcccagtttgttttgcttcccttcctcccaatccatgataactgggccttttgagtcatttgaacaccaaatatttaaatattctctcttttaccatggaggcagcattatacggtagaggcggctccctcatggagtctcaccacttggaattatcatggaggcagcattgtatggtagaggtggctccctcatggggtctcaccacttggaagtatcatggaggcagcattgtacagtagaggcgtctccctcacggggtctcaccacttggaagtaccatggaggcagcattatacggtagaggcggctccctcatggagtctcaccacttggaagtatcatggaggcagcattgtacagtagaggtggctccctcatggagtctcactacttggaagtatcatggaggcagcattgtacgatagaggtggctccctcatggggtctcaccacttggaagtatcatggaggcagcattgtatggtagaggcggctccctcatggagtctcaccacttggaagtatcatggaggcagcattgtacggtagaggcggctccctcatggagtctcactacttggaagtatcatagaggcagcattatacggtagaggcgtctccctcatggggtctcaccacttggaagtatcatggaggcagcattgtacggtagaggcggctccctcatgaagtctcaccacttggaagtatcatagaggcagcattatacggtagaggcgtctccctcatggggtctcaccacttggaagtatcatggaggcagcattgtacagtagaggtggctccctcatggagtctcactacttggaagtatcatggaggctgcattgtatgatagaggtggctccctcatggggtctcaccacttggaagtatcatggaggcagcattatatggtagaggtggctccctcatggagtctcaccacttggaagtatcatggaggcagcattatatggtagaggcggctccctcatggggtctcaccacttggaagtatcatggaggcagcattgtacggtagaggcggctccctcatggagtctcaccacttggaagtatcatggaggcagcattgtacagtagaggtggctccctcatggagtctcactacttggaagtatcatggaggcagcattgtacgatagaggtgctccctcgtggggtctcaccacttggaagtatcatggaggcagcattatatggtagaggcggctccctcatggagtctcaccacttggaagtatcatggaggcagcattgtacagtagaggtggctccttcatggggtctcaccacttggaagtatcatggaggcagcattgtatagtaaaggcagctccttcacaggatctcgccacttggaagtatgtttctcaacttcaggtctccacactaggctgagaagaggcagttggactctctaaggctttatgaggagagagcagactgagaagtgtccccatttctgatggttaaatcgaaatcatctttgcctgttgattttaaattcctgtaagtgtttcgtctatgcccctgtgatgatgtgcccaaccagtaaaggcagacaacaaatagatgaagttaataatgagaagcctctgtgaggagcagccctgggagagcagtgttccaggcaaaagtaacagcagcaacaaaagctctgagcctggttccagtgtggcacttctggagactcctggtgcacactgagtgtggctggggtacagtgacaagggacagacaaggagatagagtctgcaagtgactgttagaaaagggtgcaggtgccacatatgacataaatgccatctgactttttaagaagtttgggtttgatgacaggtataatagaaagccaccagaggttttgaggtgacagaagtatgagctgatctgtcaatgtataagagggccaacatgatgagagcagggccagtcagagcctgctgcagtggtcctatgcctggactcaggtgggaaaggtggggaaaatgatatagactcatatttggaataaacctgaagccagagcctacagtgcctgctgaagggtgaccaggaaaagagaagaatcaaagatgacatctagggttttagcctgagaaagtaagaatggcaatggtgtttaccaagattgagaccccatgaaagggagcagatttcaggggaagagagtggtggtgaaaaggaaaagtcagttttgctcattatgcatatttaagggcgctgttggacatccaagtgaagttgccatgtggatggttagattgaaggacttgagaagagggattgggaatagaggtgtgtatcccaaagccattaggaatgagtggttttcctgggcacgaactcagtgagatgaggcagggagggagagctgatctggatgaggaggaacaaccagccaagactgagacagacgatggaggttaggtcgaagaaaagcctggagcgtgctttcccagaagccagttgagaaaagtgcttcaagaggaagaaggagtcatctgtgctaaaaggcactgaatagaataagaggaaatttcatcattgttttttgcatgggggaattcctaggtgatcttgacaacagaaatttcaatcgcaaaatgggaacagagcctgactggagtggatggaaaccaggggacagaaagtaaaaagtgcaaatcagagagcatatgtgatcttttacgaagagctttgttgttaaagagagcagagaaacaaggcagttacaagagggaagggcatggagccaagagagggtttgggatgtttatgatgatgattatgataatgaccgtgatcatcataatcacaatgcacgccatgcgttgagggcttaccatgtgccaggcactgtgccaagcagtctccatcatgagctcaaggcatttttcagcaaacctagaaagaaggctctgacattatcaccagtgtagaggtgaaagaactaaggatcagggtcccaaatctggtgaatgatgaactgggagtccaaccaagatgtgtcataaacacagcagatggagatgttcctgttcaaaggccagctgaaaatgaatgaaattcttaactgttgttagtcaagacctgttgtggttgcaatgaatagaataccacctcaaaatgactcaagggagtgaaaaagtgagggaggtttaattcagatatctcaaaagtctctaagaagaactgacttcagaataactggattcaggggctcaaatggtgtaattaggatcctctccatccctgggctcaggcctctgctttccactctgttgccctcagtcttggcaggttccccatgtgctggcgtctagcagatcatggctcacttccaaccatttggaaaatccaggagtcaaagtctcatgtggctgggtggctctcattgcttgactttggccacctgctcatctgggaaacaatcactatccccaaggacacacagtgttctcaaagggactggcccacatgcctggctccagagccagcagaactgatctggacatagaggttgctctctaaaggcaacatccaggtgccatggacaaaataagggacactgggctggcggtgaagggcagatgtcccctaaagtatgaagcacgtggacatgaagtctcctgcagacagtgtcaagatatgcttcccagcattctgcccaaatctaagctctatgagggcagtgacctctttagtcctgttcatcaagtatagtttctagcacagtgacaggcacaccatagactcaggttaaaaaatatgtttattgaataatggagtgacctcaaatgattattctataatgctggtctgtttcacttgatttagttgctggttattttaattttagctggagagctcttcatgtatttgaaactcatcattattcgtcctaactataattctccaactctccaaaacccttagtttatttggaaatagggtattcaattaatgtcctactcatcagaacagtgtttttggtgtattttaatcaaagggggaaaaaaactgccttagtataaaatcttcaaatctctttgtgatgtcccctgagggtatgaacctggtggtttagccagaattgaaatccccacaaattctaaagaagctttgctttgttgaacccctgggggtttatctcctccccgctgactctgtaaggtgaggcagagctctagggaaagacaagtgcatgacaaaaagctgtttggggtatatttgcttctgatactgaagtgcctgcagcagagctgtccatctggaaaatgcaggcttgggcggtggagagaggaacaccacagaatccttgtacaggatttgaaatgttgtcttctgtgcggtgtcagtgggaggatgctgaagggcttgggctgcctagaagacatttgagctttgtgttatggttgtggggagaggcttacaagaaaaaatacagaatgccagtcttgtcctatgtcgacatgatgccttctttcccaatggtcatcaagagatagccatgtgctgctggggagatgtgtgaaccgaggagtggggcaggcaagtgagaatggtagagggctaaaaaacaaacaaacaaacaaacaaaaacccagcaaaacctcctggaaggcatgcagaagagaagcatagtgtagtgagtaccctgaacaggaaggggtgctttaatgatgaagctcaggggctgcagccctggaatgtctgggtgcagactctaactgcttcactcttccttttttcggttgggagacttcaggcaagatgcagatcatctgtgtctcagttcccctgttggtaaaatacgggtaataaaatagtactacttcacagacgctagacacccgttgatatatttaaagcattttaaacagtgcttggcacagagaaatcaatatgtgtgggtttgtttccattgttattagtccgaatgggaaaaagatgggaatgtaagtctgagtgtgcatgggagaagttatgagctttggtctgaatattcagagggcataagctttgagaggtgtgtgtgtgtgtgtgtgtgtgtgtgtatgtacacacatggaggagggacaggaggaggcaaggctggtctgagatggatctcttctggctgtatgcaaaatattttaacattctggggacagagagcacctgttgggtgtctcgcaagtttgagaagagcaattgctctgaagtcagaaatggaattactgtcacgaaaagaagcagaggctgatgtgaataattaagcctcctaatgagagcattaatatttccccaatagattgatttagagcttctttctctgggattgttgcacaaacttacctgagctggccatctatcttgattgttcaggacaaaatgcactgaaaaaaaaaaaaaaggaagaagaagaagaaactggtagaccatttagttttacactgcaatgtgaaactaaatcctaagaagggaggcctacatccaggaaatggtgagcccatggcatggttctgagtggtaggacatggaaattaggactccaaagcaagtcctccctgggctccacctcattattccttattgatttttacattataaattggctcatttcatcagaccactcccccagcatgtaatgtgccagatgcttgtgtcttccaaagggacttggaaactgaggtcaacttttctttaaccataagaacacccatgggtagaaataatttgctcattacaggcaagctcattacctggacaagcaaggtaggatgtgtctctgccagggttcaagcagagtagcacaatcagagaaggtgtatgtgtatatgaataaagttactgcaaggaatggtttaccccattgcagatgatggctacacaagaccaaagttcttagggtggacagtcaggagaggaagaccatgaacaaactagaatgggcaggagctaaagctgagtgtctaaaagtggcagccaggaaggaaggattggaagaaggagagctgtgctggcccaggggctgtttagaatctctccctcagggaagggctaagctcatttacagactctcaacttgttaagtcatgcccacagaagacaatctccctttggattaatttaaagtcaactggtgagggatttccaccttagctacaaaatccttgtacaggagcacctagatcagcgtttggctgaataactgagagaagaggcatgcatgctagagaggcagctactgccctcccaccctcctgagggggtctccccggcagcccagctaactggaaatacactagaatgtggattctgggggctgccgttcagcctagctgagctgacacataaagaagccctcacaggtggagagcacagcacgggagtgaaaccagcttccaggaggactctgtcctgcacggtgacgggttacaaatcagattataagactgcccatatttatcacactctatgtacacctcatgtcattgatattagcacttcacatttacatgcaatttcatgaattccaagcatttcctcatctgcgatcaacttctcttttgttttgctttgctttggattttttaacattcaaatagatgtgatgggtattattcttcctcattttacagacgaagacactaagggccatagaagtcaagttgcttactgaaaggtcacgtgattagtgagtgggaggtcaggtgtgtcagatcttccaattccaagtccagggctcactccactaccccaggctgcccgcgataagagacagcttgctcagtagacagatcattctcctccctggtgacaattccagttgccactgagtcttctaaagcaataggaactgacctgagtaggttatgttcagattatggctgtgggcttcccttgctgatgcgtaagttcctttttatgtaattaatagtcttggaaatctgaaaatcacatagaatccaatgttacactcacaggaagttccatatttgaaggaaaacagctagattgtaaaccccacaggggcagggatatttgtgccatttcctgctgtatccatagtgctaagagtgaagtctgccacatagcaggtttttggtaaatatttttgtataaatagtaatgcttaatgaagctgctagtcttgaatcaatggaaaacatttatctgttattgagcttttgtaaagtaatattgactagactttcaaactgactgaatttattaatgatactagcttgcttggcactttatggtcaaaatgcacattatgtacagtggcattctgggaaacatgtcctaaataccttcaaagagccatagcttagagtaattcaggagaagacagagttccagacctcaatcttgaaagacagtgtctctctggggcataacagcaaagcatctctctgtatcagctctatctagtactgtatagttctttcttctggggtatcttgtcagtaagaaccatgaacccatagaaaaaaatgttttattgttttgtttctaagtaagtaagtggcacagacaaagagagactttcatctcttctcaaggcaacacaaagtcacaagattaattaacctgcaatacactgagaacagctctttatccagtaggtgctctctgtctatttagagcgtgtagtttctggcgctaagtggtatgatgagttggctgcattctcatacggggttttaggcgtctctcctaatgcagtcaatagtccttgtgatggccaatgcagcacagtggttaatcagaactgctctctagtccgtctgcttgtatttgaaactcaacgttactatttgtcgattgagttaatgcacgcctgtgtctcagtttcttctctgataagatggagataataagagtacatccctcatgggattgttgtaaaaattaacatgcattaattatgcaaagctcctatgaaattgcctggcctaggacaagttttttgtaagtattagtaggggagttagcatcccatagggaatcagcaggacattccatctggggaagccatgcatgcgtcttacccgattcctcaagcccgatgagagtgtctgggcagggtggggcaggaaggcagtgggcactgtggccttgggcctccaggaatcctcagtttctggacaaggacaaatagggcagaaaccctctcgcagtgccctggccatagcatgtgccagatagaaatggagggcgtctggctctcagaggaagcctggctaacatctcccaggggattcttcacattcagaactcagacaaattgctgctttttaattaacacagcctcaacaactctgttatctgtcttctcatgaaactattttctctcaaatcctttctccttttcccaccctgtctgcttctgagctgtaatctttcaagctgctccctgaggagtgggctggggatggaagtggcagagagacggaggaggggtggagaagtgtagccggagtgatggatggacagtgacccacggccagcagtcgccaggctgtctgtgtacagctgcgggagacctcagctggagcacgtgggccgcagtgccatccacagctgggtgttattaaagagccggcagaattccctgacagaaacaagtggaagaagcattcaggaatggatcccaaataccccattaatttaagtttaataggacaattattgaataataaataacaaccgaatcaaggaaacatatttatcaaagacttatgcccagataatgcaatcgcggctacaccagctgagaagccatagtatgaatagctgcatcacgatgaagaaatgcccccagtgactgtctgaatgaactcagaggaacactcatggctctatcttgtcctgccaaccctctggggtttcccctaaaagtggcatgtgctgcttaggctgaggcagccccatctgtggagaaggtgacacatatttccacacggggccacgtgaagccatgttcagattttgttctcctgagtttcctccatgaggtctgtgtgatggaaatgcaagatatgatcaccttgtctcaatcaccgtttcaggtctgacccacagctctgtttgaagccttctctgtttccagaaaacagcttctttccagctccattcccagcagggcactttaaaatggcttttgaaaaaaaaaaaaattgtaaagttaaaaatatccccttccactccccggctcctaacttattagaacaatgcctaaggcagcaggggtgtcactggcagttctatttgtgatgggtctggaagagttgatatgtttatgaatatttacatctccaagaggagactgctgttaagtagattttttaaaaaatctgtaaatttccttttgtggcattaaaatgctacagcccacaacataggcagaggaaagaatgcaagggggtaggacaagtgaaccacagtatgggcacccctaatcctgtactctacagaaccccacatgccaggggctatgcagggaggaatgtgggcaaagtgttagctggtaaatgcctggcgttgtgttgtgttctcccagcttcctttttatatgatgcctatgatgctgtctgatgttagatgaaaagctcctggcattgaagtctatcagcagaggacaaggggagggaggccgtggctcattcctgcaagaacagactgtaagaatggagagggcagaggtctgtgtgtcgggcagaaagggcgtcaggatacgatgttctttagcggactggctactcagcaaatttgattgttagtcattttcacactgtcaaatatgagctactgcttcttgcttgtctctgtaaacacactgcctccttccaaagaactttaacatttaaaatgcgggaaaattttcaaaggcattgaccaagtacaaagtaggtatggtgttctcctcctcagctttcccagagaatctaggtaagtcacttgaaaacacacagcaagtcaagaactaaagggtgtacaggttctcacacacttccccaggtcgaatctcgggctggtgtctccagagcgaggcaaaggcagaaacctcagctttcagtcgcaactcatgagggcagagaacagggctgtctttcctttccacaagccccttgccggtgagcatcttgtagcttcacatgctaagcagtaactcctactgactgtcaacgacttggctcacctcttgcttggctacaggcagccattggaagcaggtgactattgagccatcacagtgccctaatttgcaagttactttgagaagaagccttcccttggcaggctgtctaaccattatgaagctgtctaccagtaggcagtcttgcacacatctctcagctaatttagagaagtcctgagtaaatgtctctaacatgctagaagacgaagatatcactggttgcacactgttcagtaaacgtgaagcccgatgacaggtgatgctcctgattgggagagggaagaagatggcagagaccagctcacagggcagagctttccagcggggaggcggtgtcccaccttggccaagagtgaaaccctgaccctttatcatctattttagagagactgaatttttgtttctccctctccaatgacggtgctacatcactgagcagctgccactccttttcagagctctgtccagaagccagataccttgtgctttggaaggaatgagaggaaatcatctgtgactgtccctccggggtgcgtgggtcccttgtttactccgcaaacttgtatgaagtacctactgcaatagagctagcgaagaccatagaggaggccctgagaacgtggttccctggcttgaagggccaaccatctcaggaggggacaaaatgcagacatgaaataacgatgtgacatgaatcagaatccatcctgccagaggtgtgaaagaatgcaccccaaggttgctggaggaattgcttcgggaaccccagctttggagcagagccgggggtatgtgtgaggggcagggattgggtctcttggctggcttcctgggcttcttcgactggggatttgaaccagctctaggacagtagccaactttttcctcaaagatgacttttgtggattctgaaaaatgtgtttattcttttgcttataaccaaagatgggaaagcacttgagagaggagaggttccagatcatcttctgagattcagggctggtctttagtgtcctcatttggaaatgagagagtggtttctggggcccgtctttgaccagggtttcatgaatctgtgactgttcactgcagttcttttgaactgtagagtctcgttctgtatgctcccctgtacggaacggacttccaagagcacaggctcccatcattctaccgggattcaaagcctggctctgctaatcactagctctgtgacctgggcaagctacttcaccgctctgtgcctcagtttcctcatttataatgtatgaattaacatagtgcctacttcctagaattcggtatggattaaaggaagtaacacatacaaggtgcttggctgagagtaaacattcaataaatacggcttcttcttaacctctggctgctcgccctcggcctcttttttgggttcttcccttgatgagcttttaaagactggtgtgactcagtcccttaaactgggctagccgatttccccttcctttttcacaatttagcctctctccttagtgagcttacctactcccctgttctctgttccccatgctcaagagtcatagcttacaaagcattgcgtgatctggccattgcttatctcctttcttattgtattcctacagaaatcctttgcctcgaatctctacatttactatcttttacccctttctctagctcccaccttcagcagaaggatgcacgtggatatgcacccatgcacacccatccacacccacatgtgcacacatgcaagcacatgcacacacccttctcacatggcttactcctactgatctttctgacttcatcttagacctggctcccttgtggaaggctttcctgatcctctccataggatagcaaagatcatagcattcaacacagaggacactaaggatctggccatatgtcagcatctgccacaagatggtaagcctagtgagaacagttattgtctgctgtgcccccctcgattcagcatagtgcctggtacctggaagatcaccaataagtatttattttaagtgaatgtatgcacaaatgaataaaggtgtcaacagatgaattccctcttggatatactccttttgttgaaagtgtttctggcttgcaattatttgagatctatctgctatgaacgatttgtctggctttatctcgttatgtttctgtccccctttttttcctgcacttttcatcatgcacataaaagtaaccgcacgcaatcactcacaattgggagcatcagtggatggacaaaaaatgcatgaggaggaaggctctgcatgggaaagggctgattctgtttgtcaggatgcgtgttgtctaatcccgtacacaccaaggctgcagactgtggcacaggccctcctaaagcaatatcacagtgaggctggaaatctatttccctgggtgtgcgcagctgccacctaacactttggagaacagcaggtggttcatgaagaaggcagaaagggaaggctggttaatttcagagctgaggagcagaggggctgatgagtggagcccttggtcagcctggcatcctcaaaggcggaggtaatgagaagaatggctccttaagaatggcttggtggggtttcatatgtgccctctcacgatcaattccagaggaaatttaggccagtttcaagtcaaaataggatttttttgaacagccagaagagaaaactgcacctggacccacaatcccagctgggctctctctgcctcttgcatccaccctggtaataaagattctccaacaagaggagagttgatgaggtggaagatggaagggaatccatgtgtggtttgcttgagccgacctggctgcccaggggtccaagtgtgtttgtgctgggtgagtcgacagagatggctgaagaaatggggaaagtgtcgcctctgagacttgctgggtgtctgcaagtgttttgcaggaaatcttttcagtgtggaactgtacgtgagagacccttttctctgctaatctcgtcccctaattttctcccttgataattaaattacagtagcaggttgatgccaaaaatagaggaggcgtctcgggtgtcttcaacattaaattttgcccatgacagaaatatgacttggttatactgaggcttcttgcttcagcgagtagctgagggttccagtgttaactttggccgttaaaggcaccctccgataacgtttggaaaccagccagcgtctacccctgtggttccctggaagaacgtaactgcagagctagccttgggcaaaatccaaaaggaacagggtaatagttaacctagaccgctcactaacagtgttactctgagcttcaggaagccagtgtgggaactgtgtttgggattagagtccccccaactagcctattgggagagttgagcagtggatttctgtggatacaacaccagcacttacattccctactgcaccgtttgcgtcccgctctgcctctctgcctgcccacctgtaaggtggtggtcatgatgcgcctagccggcagaactgtccaaagactgagaatgcatctgtcaaagggtttattcatcgtccagtgctccatgcatgagggcagcgtgtttatttgctttttcttcactccgtacacacgaggccatactatccattaggctcccaggaccctttctaattaattctgggaagggttactgagtgtggagggtaagggctggccacgtgggcgaggccctcggcattccttgaacgctgcagctgtgcagtgccaggagcctgccttcattaaataggagccggggcctcattgcgtttccgtgtcacatgtgactgtgggcctaatggtggtgattagtcagtgtccagagagggaataagcaggctccccccaccccccagctctgcacggcatgctgagtgatgcattcgatgagggggatggaaaggtcgtttgccaacaggactggatattgatccctggagccaggtcctgggatttggaggcgactcgcagccccttctgtggaatacaaacagtgttgccttcttgagggctctaagcacccggagggaccagaaaggttgctgttctttgggactggaggggcccgaagaagacctatatagagtgatgtcagaaatgctgtgacttcagggaggttttgtctttttaagtacattctcccatccttttccatttcttaattcataaagctgtattcccagggatgcagtcccatcgtgctgatagaagattctttggatcaaggcaacaacagggtataggatgtttcctttgaaaaacacgaaaaagtcatcttagagttaagagcaaagggtatatgcgacgcagttgccagaagaggccaggctaggatactcgaagatacagtgcaggatgcctttctcctttcctggaagttattcctcatctacttctagatgaaagtgcttccaggcaattgacaagtgcagagagactgcagagggtgggagaggtggcagcagcaactacagcggaaagagaggcaaatgcattgagaggcagctcccagccataaggtgtcactgctgtttgaaagttgattcaatcaatattaataacatgatgccatcaccgaagatttactgatacattgaacacttactgtgggccaaagctgtagccaagtgctttacaagcgttatctaattttatcctcagcagccctaagaagtggtggctgttgtttttctcatcacacagattaaaaccaaacatgttcccatgagtaagaatcccaaatggtgaaagtctaagtaacttttccaaggtcagagctaaaaaatgcttggggattaagtaacaatctgagatttgaactcaaactctccaaaatagttaatcctatcataaagttttttccagctaacttgcagtatttctcagccttttatagtccgagcccccataaagcttcctgattccttccctgctgatctctagcaggtaagaagatgttctgtgtggttttacattcagctctttgtattatgaaatctacaggtatcgttgcttttaaactgcacaaaccacttctccgagtgtttgatgtgcttccctgtacttcaccctttctccttctcccatcctggtggtattgacttccatattaatgcgagagcacttactgagctcccacagagagacgcagtcacatacgtgcagctctgaatgactcactgccccgcccaagcaagcaagaggcccctctcctgtagcaggtactcattcctgatgggcacaggcctggacgatgtcctgccacttctacacaaggtggatcctgcccctctttccaaattccttccaagccaagtcctcagtaaagccgttttcagacatccaacactcctcctgacacatgcatgcaggaattaaaagaaaacatccctatagggaagtcatggacattccatttggaaggactggaggggccagatggggaaaggctttgactcacaggaaaagagtttgacactttggattcctttaactaaaagcaacaggaaatgactgaaggtgtttgaggaagagagcagagttttagggagatgagtggaggctacaggttgtggggtaggtggggtgaatgttaggagtgagcttgagaagaactggaatagctcagtcgtgcagtgggaggaggaggtgatgaaggcattccagaggtgaaaatatttttatttaagggggtcaaatagtgtggtttaaaaatgccataaaattcaacaccttttatccagcattcaagattaagtagttgacgtgaggatgtcattaattctggacgtgttctgcttggttgctgaggaggtgaggaaatagagggaaatagagggtctgccatcccccatctttttttttttgagatggagtctcgtgctgtcactcaggctgtagtgcagtggtgtgatcttggctcactgcaacctccgcctcccgggttcaagtaattctcctgcctcagcctcccgagtagctgggattacaggtgcccaccaccatacccagctaatattttgtatttttagtagagatggggtttcagtaagttggccaggctggtctcaaactcctgacctcgtgatgtgcccgccttggcctcccaaagttgtcctcccccaatctttcacatgaatgaggagccttgctttcggtccacgacgtctgcctgatgattggaaattcacacacagatacacccacccatgactgccaagaaggacgttttggctgaggccactgggattcatgagccgtacctccctggtcctggcatctggggagcttcttgtaatgcccacccagacactgggaatgcaagcaccatccaccccctgttcatgggtgcactatgaccaccatccaatgggtatacactccactcttcaaatgagtgtgggtgaggggacagggagtgcacatagcacccttcactgttcagagttcacccaacccaagcgcctctgatcagggctggagggctttggaaggcatgaggaggcaaggacttgggggaaatgcaataaatgtaaaaactagtccttggttccctgtgcccctcctgagacctgctgaggttgtcttgagcacaggggtcctgagacagaaggaaacgtgagggcaggaggttggctcctgctgcagcatacagatgttgccttaccttttcaggggcatagatcttaaggctaagctgtggcaaggataaagcctatgatttttccctctccctggcactcccctgccaaccctccgcctgtggaatgcactctgaaggcgctgaaaaggccttggagttgtgaaatcttaaaacacatggatgagaaaacaagccccagccagcataggaagtgggaatgggggcatttgccactttactgctaactgctttgaaagaaaagagacaggtgtgggtcccgctgatttctgaaactgtcacagatgagaagcagtatgagactgcaggacgctttgtagctctcagtctggcacccttgccaagatcacagagacttgggggaggagttgtttcaaccaaaaatggcagcagggtttttttttttttggcaacatagaggcaacagtgagtcagaagaataagagggggatcaaccctattacaaccaatttttgttttttaaaatcttggcctgaactcaccttagacagcagagagttgtgggatcgtaactcagccctgccacttgctagctgtgtgaccttgggatatgtacttaacctctctgtgcagcagttttatcatctgtaatgggggataataatgatccctataaaagagttaagttatgcattctctaatatctctgggctagagcctggcattatataataactcaattttagttgccattatttaggaaaaaaattaaaataatgaatctttttataattgtcaatcaatattaattaccatggtctcctgatagtcatagcccatgttggctaaccaacaaccttgaggcagggaatttattacttttcccacattttatagataaagaaaccaaagcctaaagatgttctacaggactgtgaaaggaagggtgaggaaaagctaggagatgagtgtcccacccgagctataagcagccccagagagacactaagacaggagctgattgggaccaaaggcatggcccacatggcatggctgggtgtgggaagggacagacagggccagcgcccagggctcctaagtctgcacccagagctctccccatgcactcggttcccaggcatccagccttgcaggcagaaagagaggtggccaccaccctacttgtagagatatgggccaagagtggaaaggtctctaaaatccttctgctaaaacttgcagtttaacaagtagagtgattgcacatcctcctcctagtagcatgcattcatttgatgcttaggagaccagcacactgagtccaaggggaccctaatctcaaggacttggctccaaacagccagaaggggcaagagtgtgagagacgctcagttagggtcacccattaagatcaaaggttatcttaattcacacaaattctaaccatttaaagtcttggccctttttctgcctatggagagttttatccagcatggcacagatgatgagcttgctcttctttgaaggtaagtgctaattgcaaggtaacagtgaccttgccaacgcaagagggtgatgagtcaaagacagctgggttcccttcattttcttcagtaggatctgaatttcctacccagcagctgtggatacctaaaactgacatttgagctaagtataaatttcactcgctctctaaaaaggtggcaaaatgatctcatatataggagcttgcactttacactccagtctagctccgagtaaaatatactgcagctaggttacaagaagacaatcttaaatttagaacattagaggtcattctgacccacctcctacccaatgcaataatccactttgaaagactctgcagatggtcctgcagcctcaacttgaacgcttccagtaacagagagctcagtaccatgcaagataaagaaagttttgagtactttttttcttaaattgaatctaatctttggtttcttataactcttacgtattgagattacttcccagaatgatataagtcctcatcctcacagtggtgatccgactaactttgaagttagctctattgacccaaataagtcttgtcttttcatagtgttcattttccattgattcagccatggcttttgattttcagcctttcactatcctcaatgccctcttctaggggactggatagcctggtttgtatgttttcgattgggaccatacagtgtggtcaggcagagccctttgtcatctgagccagggtggccgggagaaacagaacactgtggggagggaggaccaaggtcatggtcttggagctcctgcagagcatcacagaggaacaagcaaagaaacaggagggagtgaagtgcagcaaatggattatgaaagagaaggaggaatagatgtgggacaactgaagatctgggtctgtcctcatgccaataaaccaggctgccctcccattccccacctcaccataaacttaagctgccagttcttttctgaatgcagaatgtagtcctgaatcaatgtcaactttgtagtcttggattatttttctcagagatcaaaatatttttgaatcctgattctgtcttcttgaacattaactatttttctcagcttcatatgctctatagaatacattaggttgcattccaaattctttaccaggtcattgtataatacaacagggccaagtacagaaccctgaagcacattagtgtgcttggcatggtgtttgatatgctttaatagacctattgcagtgtttgatgattgaatgtgggttaaggaggaaatagcaatgtaaaagaaatatgagatcatctaattatagcatgtgggcatgtaaacaaatgctaacaataaaatttaacatttctctcactagaccgtggagaatcttttattgatctttgcaatcttagcagctgagcagtgcctgacacataataagaatttattccatatttatttttacaaatgtacaaacacacattcgcaccatcctgggaaagaattggcattagggaagttcttaactcgataccattgcacttaagcagcaaccctttaaagcaaccatcatttgttgtccagtagccacttctggacaccaacttttctttttatttcactttgacattttaagtagactttaaagttttagtttatctaaatctcaactactttaagaaaacctggtcttcatgttgatgtattagtttgctagggctgccttaacaaagtaatacaggatgagtggcttaaacattagatattcactttctcatagttttgggaactagaaatccaagatgaagatgctagcaggtttggtttctccgaggcctctctttttggcttgcagatggcttcttgcggtgttgtctgtgccgctgcgcccatggtgtcttttaaccttattcagcctcaaggttcccatttatagaatgggcatactcatttatgtgtccaaatgtcctcttcttataaggacaacagtaatataggattagggccaaccctgacgaccacaccttaacctaatcacctctttaaaggtccatctccaaatacagttacattcttaggtactaagagttaggactttgacatgtacattttttgggggggcacgattcagtccccaagaatagggcgtgaaagagaaatagcaggcacaggctcagagatctgatgtggcacttagcctgtgccacatactggaagaaataatatgagaatagccaaatactttagtctagatctgttctggctcaatttcctgactccttaccactagccttttttatgtgaggagtcttgatgtccattttcctctcatcagagtgagcttggaggtgctgcctgtgcctgtaggtcccattttctctttctctgcagccttgatccaaggactgaacctgaagatggagtttgttggagagatccatgaacatgcacctgcaatattacttttgtggttgatggagtagaaagtttctctaggaagaggcagcattgctgctgccctcggcgacatgacagatagggtggcaagccgcccggcacaccctcccctgtcgggctggctgcagtcagaatgaaggtaatctatgagcaagactgcatatcaacagtaccctcccctctgtataaatcaggaagggataatgcttattaaaggctactctcccagagcatcctttcctcccgcctggggcattatccatctggtgttgaaggtcatatcaacctgactggggagaggggaccatgcctaagaggacggagaggctgatgatcactgcaaagagctcccattgcatcatgccaggattgagaacatgtctctgccggtgcccgtgcgaaccagcgctattagagcatggatgaggggtgcataaaaaaagatctggggtccagaatggagggttcctgcaagttcacatgaggctactcctcttataggcttagtacttgttccttagtaacaataagagcaaaaaaaaaaaaaggaaaaaaaacaacagactttactaagcacttacttctcagtcacacttctaaatgttccttgcgtctaagcatcatagatctccttggaggaaggtactgtagttattttcattctctacatacagcagcattctttattgaagaacgttgaggcacagtaaaggtcagcaatttgaccaaggtcacagagttagaaggagataaagctggcattcaaccctgaacaatctaactccagattttatgctttaaaaatgctgcacgccatatgaataaacctttacatttcataagcactggatttatgacaggtactggcctaaggtcaaataacaggcaactggcttttcagtgtcatatacagcacttgcatgcattccctctgtctctctctctccctctgtctgtcacacacacacacacacacacacacacacacacctatacatacagagctactcttctggtttgagtaatgacactggcctttgggtagctgcttgatagctggttgggatctactgccccatagagaagtacaaacttaggactagtaagaatagaggtatactaggccctcaaagctgcccagagccagcttacccctataggagcatcccctcagcctctttctcaaaatatcaccactgaaagcatggttggcaagcaagctctttcacactgtgcctaaattaattgctatacttgtttccatcgcaactaagtcattttttgcatcaaggaagtaataaagggtgtcagttaagattactgtttttggagacaaatggatttggccatcctgcatttggcatgtagagttggccctgtacaaattacttaattttgaaccatggttttcttatctttaagttggggatatcgtatctgcctcagtattgctgtgagttgatacccgtgaccacataattagaaagttgcagagatgggattcaaatctaggtttgcttgactggatatctataaccactagctgcatatttttaaactttagcctcagtgttcccatttatagaatggacattctcatccttacctcactgatttgttaatatagcaaaatgctctattcaaaaaataatgcagtgctgagcacaccagcttcaacgtgacagctattatataaagaccaacaaagtaaagttacacaaaccataagaaaagctttattccctggaagttgcaaatgagaagctatttatatacaattttcttctaatagctacttttgattttgatttctatggataggagtgatatgtataatatttggagtgtctgagatttcaaaatagtcaaaggagctaggtggtattgaagacgtcatgaatgcatagtcctaaatgagcctactttttcttgaatatggccccacccctgcacagaaggaggggtgaacagaatgctgcagtggggatggcatttgttgtcagctttggaacaaccaaagtactttgtcttgtcagcttgctggtaattcatcaaaaggaataaatgaatagaatgccttgtgtgaatctaatctcttcaacctacaagactcaattcctaagaaggcaggcaatggaacccagactggagaaatagaatttaaaagatgaaagagccttttctgggtaatatctgcattctttttttaatgaatctatttttagtccttgaacaaatggacataaataattccaaccactgacagctaaatatggacaaccatttctggactgggagaaagacagactaattatattaatgtagagtaattatatatatttatgttcactatcctcattgcagtgctgagataaaattctcttcagaagggaattggtgaagtcagagaagcagtaggttgctcagcagatgtttgggaagtttcctgtgaaatgccagctgtctgaaagtagaaaaaatgtttgtattagagtctttgagttgtaccaattccaggtcggaataatgcaatagtcacggaggatcctgccacaggtgataactgggggctgctcagttagattctggggtaggcttctttcattagtatcttacattgggatcttggtttaaaaccagagtggagttctgtacctactttgtgcatgtatgtgggattattgttggaaaaagatatttaaatgaactcttttgccatttactgctgtgagttctagacttgttacccagattctatcgtacatttgaggcatcaatgtccaaatgatgttcccaaacttttacaaccaaaaccaatacaagcatgtgcctttttttccccctggtgatttgcaaagggaatgagcatgctgagctgggatagactacacattctggatgaagactgagcccaccaataaagtcagtgttccaatacaggtacagtggtttggacctcaccgttctgtgctggtagatgtactgggctggggcattatgtaaggggacaagtgagggagttgtctgattggccagatttgagtcatttgctcaactttaaatccttttgactgaagatatttaaccaggtcaaggtcacatgacctctgttctgtctagagaagggctagccccaccagatcccagtgaatgtggaaggatgagaggaagcctctgtttacagaggagattggaaaaagggatgttggaaaaattaaactactggatatccactctagccacctttcaccatctgattttgaacagagagtgtaatctcatttagctccagataaatggcaatcagtcttttcttcataaggttgaagattaaatgagttaatgtacagaaaaaaacaaagcactgtgtttggcatagaagaggcactcaataaatgttaaccttttggtaccaaatagaaacttgtatttttattcttgttgagaggtcttgaagtgctcatttgaaagcttggttctaatgtttctgactgtcctgtgatgtaaggaggaaagggagaaaattttttttctgtcatactgttctatattagtcccaataattccagaacttctctgtatccctcagcaactctcagagaagtgaaacctatagccactttttttattaccatgctcacaccctggcaacttcccatccacccatccatccacccattcatacaccatctatccctccatccaccacccatccattcacccatctacccatccatccaccaaccatccatccatccatccaaccatccatccatccattcacctacccatccaaccaaccatccatccatccattcacctacccatccaaccaaccatccatccatccattcacctacccatccaaccaaccatccatccatccattcacctacccatccaaccaaccatccatccatccatccacctactcattcatctatccacccattcatacacccatcaatccatccattcaccaaccacccatccatctatccatccacccatgcacacattcatccacttatttaacctgtctacccatccacccatctatccacccatcaatgcatccatctgtccatccacccacccatccattcattcacctatgcacccatttatccatctatccattcatctcttgaagaggtactttttgcgcacacactaaatgccagacttagtgataagtgctgagtaaaccatcatgttttaacaaagcccgtgcttacagagctaggttgtgataccttttttctctggaaattatatcctactcaagctatttgtagggggaagggaacacgaagaaacagtaaaaacacatttccccaattttccctagtataagctttagtgagacttttaaatatatattgttataatgccttctttggaaaaaaaaaagtccaaactctgagcacagtgcaaaggacgatggaatgcttggattccccttcttggtagggtgaaattcattaaggaaaaaaatggcaggagttcagactttcctggatggctttttaggagaaccagagcattgaaatcatctccaaatagccttttaaaatctaaaatgagcagttttattaattaaatatttaatgaatattctagctagcatattaattctaggtaaagttgatgaagcagggggctgcattttatatgctgtcttattttgtgtctgttgtgaatattaataatatcttgcacttcattcttgtggtcttgatgtggattcgttccttgaaggctcatgatgattctgttagacggatgggacacagtgttctgtccttatgtacagattaggaaaacaaggctcaaagactttgaatatgtggttcaggagagagacaaggagtggcagggacagagcatgagcacagacctttcagggttaagttctacattatttcccatctaccattatcgtacttgggggtttgtgagcatgtggcaggagacgtgaggcatacattgttacccacattgtaagcctttgcgtataattgtgttagcctcaagtttcgggattcagctttgccttctgggtcatgtttaagacatcattaagagttgacagtttggttaggagacttggttttgcagtgtttctgtaatgagaaagttcacttactgcaggaatacccactagggaacagtttctgggaatgtagtgtggccagaagagggcatttctccccagatccactccttgtgttgaggggatgtgacagggagcagctctctggggtcagtgggccagcagctcaaacactaattaccatctcttaagatgatggtgaccttgaccaagttacttcacctgtttgtgcttcccctccctcctctgtaagatgaagataattattccctacttagattgctatagataatgaatgagttttacttaatttttttttaaattttagattcattaggtgcgtgtgcaggtttgttacaagaatatatagcgtgatgctgaggtttgggcttttagtgatcctgtcacctgagtagcagcgtagtacctgataggtagtatttcaacacttgcccctcacactttttgaaaccctagagtctattgttcccgtttttctgtccatgtgtacccaagggttagctctcacttacaagtgagaacatgtggtatttggttttctgttcctgcattaatttgctcaggagaatggcctccagctgcatccatgttgctgcaaagaacataatttcattcttttttatggctgtgtcgtatttcatggtgtatatgtagcacatcttctttatccaattcaccattgctgggcaccgaggttgattccatgtcattgctattgtgaagaatgttgtgatgaacatacaagtgtgtgtatctttttggttgaacgatttattttcctttggctatatgctgactagtggccttgctgggtcgaatggtagttctatttttagttccgtgagaaatctccaaactactttacacaggggcttaactaatttgcattcccaccaactgtgtataaacattccttttcatctgcagccttgccaacatctgttattttttcttttgactttttaacaatagccattctgactggtgtgagatggcatctcattttggttctgatttgcatttctctaatgattagtgatgtcgaacattttttcatatgcttgttggtgcatgtatatcttttttaaagaagtgtctgttcatgtcctttgcccattttttaatgaggttatttgctttttgcttgttaagttgttcgaactccttgtagattctggatattagttctttgtcaggtgcatagtttgcaaatattttttcccattctgtaggttgtttactgttgatagttcttttttttttttttgctgtgtgcagaaacactttagtttaattaggtcccaattgtcaatttttgtttttgtggcatttgcttttgaggacatagtcataaattatttgtctaggccaatgtctggaagagtatttcctaggtttcttctaggatttttatattttgaagtcttacctttaagtctttaatccatcttaagttgattttttttgtatatggtgagaggtaggggtccagtttcattcttttgcatatggttgccagacaaatgagttttagcaactatgggggaactgagtagtctgtacaattcattcatgaatctctctctctctctctctctctcacatgtacacacacacacacacacacacacacacacgctccttatcaaacaactgaaacctttgtgcatgtaataaacttttgatcctcactctaagcaatgtgtgtacttgtcaaagtgagtggcgtggtgggatttggatggataattatctcggaaagtttcctgtaagcagatgaggcaagagtaagctcctgacaactaccttcaggagaggatggtatggacatgcaccctttccaaatatatgcttccccaggctgccacagtgcctgacatcccacctgtaggaattattccttgggttttatttttttttaagacatgtgtgccttttaaacaattctgagaaattagactccagaaatattgcaatgagtggtgcctaagtctgcagagggacaagtggcagaaaataaaaagaaagaaataaaaataaaggttactggttgagaaaagatgtgggagattttgcagctccagtgattttaatgaaaagtgttcaaaccttacttttatacctgaaagagaggctaaccaccatataactagaaagcaactttttaaaaaatatttattcactacatgtagaattccgaaaagcacattgatactttgctgaggtctgactcaggttgtagccatctctgtcagctgtccttcacacaggaaagggtattattggcatggaggtacaaaacccacacacactactacactcccaccccacctccccccacatcccaccacagacaccacacacacacacaccacatactacatacacacatacacaccacacgtcaaacacatcacaccacacagtcacatcacatatgcatacacaccatacacatgacacataccacccacacacaccatcccatgcacaccacacgccccacacatgcatcacattatacacacacaccacacataccaaacacacacaccatgcacaccacacatacaccacacataacacaccacacacgtaacatacccactacacacgtaacacattcagcacacacacatcacacacaccgcactacacacacacacacacaacacacacacacacacacactacatagaccacatatgacatacacacactagttaagtgactatttctttatttttgctttaactagcatgtctatggtaagtaccttctttgttacctgaacttagcctattcatacaataagagctaaattttgctcagcactttcttagcacttagcataaattatttcatagtaaccccatgtggtacagattattactattgtctcctgtgttagtagagaaataacctggtggtaaccaaccatctcagtttgctcgaagctgagagggtttcaggaacatcagatgcttagtgttgaaactgtgaaagtcccaggcaaactgtgacaagtgggtcaccacaaaactgagacacagagaggccatgtaacttcctgaaggtcacagagctagtgagcagtggagctgggattggaaactcccaagcatttcagctacagatccctccaccttaagttcccatctgccctctgtggcctggctcaactcttagaattctccaccatgatcagtctgttaaaataaacaggtatcaaggttagtcatgtatctcataaagtattatgtatatcaagacactctaacatatgtatccaaacgacatatcaactattcacaggaaaaaagaatgcattagaaatctaatatttttttttaaatatgaagcacaaatccaacatatgcaagcatcatatacagttgtcatacttagacactagcgggaaagacaaaactgattgcaggcaactgttgcagatgaattactgctaaacacaggttccttatcgtaagagctgtaggaatccaggcaatgcacaaaacaacaagaggcaagtcatgagagaaagcactatgaaaatgtgggacattagctagaaagaatcacagtttcacctagaccagatttaggtgtttggaaaggagagatttctagatgggaaaacaagagaaaaaggctgccagcaggacaaaacctactgcgtggaggatgttcaggatgaggttgcaaaacaggaaccagggatgagaaaagaggatgcaaacaggtttccctaaagaagaggcaggcaaggtgctcactcgtcaatcagaccaccacccttcagggtattacgcgtggataagtctcaggaaaactatcaaatgttgacagctgaacaagcccaaaccccaaatccattttgaccattttttacatgtatgcatttgagtgcaaagaggcggaactctgtaactgacttctctaacctggctcgaaagctttacagattacaaagcttcatcgtgattaaggctattaaaacaaaaattactcagatgggtggtgttttctaatagttattatgtgcaacagaaaacttgaacacatatgcccaaacttctcatcaagtcatgatgagagaaacaataatacagtaaaaatcaaatttaggctgggcgtggtggctcatgtctgtaatcccagcacctttggtggccaaggtgggtggatcacctgaggtcaggagttcgagaccacgctggccaacatggtgaaaccccatctctaccaaaaatacaaaaaattagccaggcttggtggcacacacctgtagtcccagctactcaggaggctaaagcatgagaatcacttgaacccaagagacagaggttgcagtgagccaagatcgcaccactgcactccagcctgggcgacagatcgagactccatctcaaaaaaaaaaaaaaaaaaaaaaaaatcaaatcggcaggcaccttggctcatgcccataatctcaactactcaggagcctgaggtgggaggattactggagcccaggacttgagactagcctggccaacaagtgagacctcatgttgattaaaaaagaatgaaattaaaataataagaaaagaaatacccaaacgaaccactctttttaaattttcagctttgctttcaaccgaagaatccagtgttcctgagagagccgactgactagattaccaaatagttaagggttataaagtttggatttcttcaatacagttacccaaacttcacctgagacacacattttgggaatactcttggctagtactggtttcaagccattaggcaacaagttatataatcgaaaacttaataacagccataatcatccacagaaatgtcaacattaaaaatggactgtcctagtacgtggagatacaactcacaggtgagaagagatggtgtatatttgcacaaataaaaataatttacatttctatgaactatagaataagtcaccccatatttgcgtatttatgcttaccattgggttgtattgcagtctaacattctaattactcccaaatcaatcccattttcctccctatgaaggaaaattagctctaggcttatctatacatatactccatagatacctcagcacatcagcctagaagtgtttcttaaggcatagtttgaggacttcctgtgtcagaattatcagggcagtgtgttaaaatgcagattcataggctctgcagtgcgcattggttcaggaattcaaatatatgcaaatttgtatgctgtagataatctttatgcactctattttggaaaatcactggcatagaagggacatgaaagcaggtcctttccctcaccaggtcacccaggcagtgatagaactgagtcctgggagagtcattttacactccaagtcttccacaaaatgcccttattaacccatattcaaaagcgcgagggctggcaaagatgcatacgttaagaacctccccatcccccaccactttcatagaccaaacatcttcaccactgtcaaaattgtccagggaaagtctgagacttgcttgacatgttttgcaagttgcaattaaatattcacagggcaaaaatccctgtgtagttctttgttgtacatgaattacgtgcaaagggtatattacagcaggcaataagcgtttcttaaactctacatctcattacccgtgaaacctgcccctctgctgtgtgagcagctgcttctcttcttcctgtgtgtgcttgacctacaattcctccatgtctaaatctctccagaggtctccatcctaatgagttaagttcaatggacacgtgtgctgtttcacctgtaaagaacgcacttccttcccagagcatgctcccaacttccatcaacactgcacaacacgcttgctctagaagctttttcttcgcttctcaccccagccccccaccaacctgcctgaggttggtctgatgaatcctccttcctactcgctgtctccaggaaaacagtgttgaaatgtcccctgtttttatgcatgtctgtaacatatgctcaggtaaactggcatttgccttagtttctccatggaccataatgatcacatgggagggagctgtctagcacttcctgtgaaatacgtaataaaacccaactccactttctgcgcaacaattagctctgggcctctgtgcagggtgagggtctgatccatgctgctggctgctcagtgactgttattcttccttcaccttatgatgcatagaatggaaatgcttcctgccacccacagaatgaaactcgatttccccaagtgttaattttattaaagcaggcaaaccaagctaatgtgagtccatcactatgagtcagcctcgtagctcacatcaagtagactcaggcaggctttttgttttcttttattttctcccacagcctatttttaaaaccctctgtaaatacatttaataatcacttggtagattatcatacaaaactactcttaactaaatttgaattcaatctttatttgaggcagtgatggctaatattgactgttgcgtagaattatgagaagtccctgagtagtcagctccagcggagcctagatctattttttaaaaccagttattgatttctgcaaataggctttccttgaggctccagcagatcatggtctttaggtgaagtgtggtaaggtgatggatagtgagggtgagtacattttccctttgttcatctacattcttattaataataatatctttcatttataactcctttcatccccgagcatcgtgaagtgcttagcggacgtaatgatgctgtatggagaaatccatcacacaacccgcaggcaaaacgcagcggttgtctagctgtactgcttggctgcactgcagcttgggacaccaggaggaagtcaatggacagccaaagctattttaagcagataattacagggaactagattggagtggggctaagccctttgacctaacactcaccaatgtttgaagggctctgcacctgcttatggcactgagtcctacaactgttgcaccaggtcggggttgcaatagagcaagcaggtttatgttaaagagctaactcatctgagaacagtgtttcattgctccccttccaaacaatgaagatgccaaaatgcatgagataaggccaatgggtgtaatgcgtgtacaaatattcgcctgcctttccccatgagcaggctcagcagcaaaagcattccctgtattgctagcaagagcccatgattccaagcatttcctctccaatgctcctgtttcctctcttaattgcaaaaggaaaatatgatggtctgactctctggaattaatgggtaagctttgaagggaaggattagtttaggttaggtctctttgccacttatcgattgtgtgactttggcttagtggcttcctgttattattccacggatgatatttttccatggtgcgtcaccaaaaccccatccaaaaagcagaggtccatctttgaaccccctatgatgaatatttatctggacttctgttccaccttggttgggtggcacattacagatattaaaaaatgcgttggaatgagtacatatgtgcagacagtggaataagagccactggagacagcaaaagacgggagggtgtgagggaggtgagggataaaagcagaaaaaaaaaaaacacctattgggtaaaatgctcaccatttgcgtgatggtcacactgaaagcccagatttcaccactacactgtctatccatgtaacgaaactgcagttgtatatctaaatctacatgtttaatgtgttgattggttaaaaagtaaaataaaaaacagaagaaaggcatgagtgggaaagaacagtgagttcatccatcaagtttcccttcacaagagtgtgccatcgggactcataggttatttcaagtgtttactgtgtgaagtcatttttctcatcatttggacatcttctgaaactccactatctccagaaaaatgtgtcatctccatcagcagaaaattgccagccccttcactcataaccaaagatcacatggtgagttcctcaggccctactgcgaagtagaaacccagattcttcccaccccaagcaagccactggctgaataccttgtagggtgtcagtccctttctctcattcaggacttaacttaatggttttactttccttctgtttgacctatccatgtgtattcagatcactgcatgtgcttagaaagcagccccttaaagactgagcatccagtctgctttgctctgtagcacggggctcagcacactgccgtgtcacaggcaagtggagcttaaatgtcccctgatgccaacgattgagggtgtgctaatttgctgtgctcactgggtgcagattattttcgaccagctcagtattggcggtgtgagcaagacactggcttaattaccttctctaatgactgataaggatcacaggatgggtgagctggaatgctgggacaagattagaaatgacatccccttattgccactttttcttcaataacatgtggctcatacctttaagtgagcaagtgtctccctcctgcccgtagcacaggaggaagccgtgtactccctgcccacttgattatcctgtctccagctgatgcagcaaagctcattgccgttgagaaagccttacgtacaaccatgctgaccacacagaacaaatgtgtcttcggcttgtgaactggggtgtatcacagaaaagttggattatgaaacagatctccttgaatagaagcgtaccctgggggctctctcctggggtgtccacttgacgtttgaggtgggctgttcatgaaaacaagtttctttcctgtctggacttaggagttatttctaagaaaatgctctcgcctaaaaaattgggcaaaaacatttcaccatcagaagtcaatgacctccacactgcattgtgttcattctcttacctgtatgtatcctcttacaagactcaaagcttcacaaggaccatgtcatcttgatgcctaattcagtgtctggtccatgggaatgcttgataaatgtctcctgaatggctgaaggaatgaagtaaggagtgggagacctctacaataaacacagaaatgaatacatcaatgaatgagccagggtgcatgtgtgtcttaggttaaatggcctgtcttgtcatatgcattgatcagttaaaagtctctgagagtctatgtatgccaagtgggaaggagaaaaaaattaaaatccattctttgccaaggtcactcttgtaagattttccaaaaaacatagaaaaaaaaagtttcttactgagatttgttttaattggcgtgtaccaaactaaatattaaaagaaaatcattgcttttctacaccattaagtcatttttttgaacatgaaattggtcttatcccatagctcagaaacattactctctcgtgtgtgcaggtatcagccaagaactgacttgtgtcagcttattttgatccatcttgaaaatcccccctctttactcactttttctctaatcctgagttcccagaaaaggaaaggaagagacaggatcccagctgcctgctctgcagtacagacagctcaggagagatggagccactacctaaactgcttccaaagccactggccctctgctcctctcagtgctgagccaatgtctcaggaggcttctgaactgggataatccacttgaagtagagactaaaaaatagaaacaagttgggttaaagatattcagaggggttgaagtgggctgtagcagacagccatgcagcgtgtctgtgggtgaaagggagggaagacagatggagaaggaagcacagtccagctgaggcgggcttgcaatccattgcaatccagggaggccacacctcaggcctgcctcattgagatgggccgaccatttctgctgaaactgtctttctacgtatatttatgtagaatacccagcagccctgcaaggagctactgcttgttattttgactgattacaggcgagtgactgcattgtaatggcagcagccactcattagctctggcgagctagacagaaaccctcagctcattccgaccgcatccgcccctggaggtgaatattcaacaggaattgatctccttaatgagaacacagccgtgctgcttcgattagcagcagtggaattttaaatagttaattatgacaaagggtcagcatgtgcatgtgtgcactggggagcatgcctgtgtgcgtgtggttgagtggaccctcagctggtacgtgggcctgggcttcataggagggcaattccggagaatgacactgggttttcagtggttgcaccaggagtggcccttcctgtcaaggaattcctagaaggaagccctggcatatgcgcgcttcactctgtgcccatagggatacccagggatgctctccatggtactctgcccagtgcccctttcctgtgacaaacaagcccatggaacaccgtgggttgatgaagatagatgttgtagtctaggaagggagatctctctgttcaaaacaaaatagctccttttttctaaaacttagctgaaagaccttcttccccaaacccaatgaacataattaagaataggctgaaatggacaagaagacatgataattgattgtggtctttctgcctggcagctgcacttaattaacctttagattcaaatatcaagtggtgtccgcatggagagacatggagaaggggccgcctgacctcacttctctctgctcactggaggggactggttcagaggtcaccttggggctgggcctcaactatcttatctctggtttcacccaaacatcactcaggtacctggagttccttttcaaatcctgaaggacacaagaacttctcccatgtggtggttctactgcagtctggtctgcagctttatgtcactgtcttgcaaatgggagtccactacttgggttcttcttagcctggcttttcaaaaggcaaccaaagccacaatccacaggccaggtgtcatgtgtccaggaaacaaaagcaagacagtcctgctctggtctcttttgtctcaccagcctgcagagatcataatcactcacagtaacatcatctttgagaacaaagcccagagaatgtgaggattgtaggtgagcacaggggatttgggactctgttcaagctcactccacaactgaaaaagcaggagcagagtcagtgtctcagtatcatccctgtggctcatgggagcggcacacagagctttggttttgtcagtcctcatttaagggctgaccctggtgaagccgcatcagctgcggccgcctttgaggcatgttgctggggggacgacacagcgtgtgcctcggggtacacggggccataggtgatgctgtgtgccccggcacattcttgccctctgggatcaggaagaggctgtttccagcacaagcccagtcggagctctttatactgaacggcttctcaagggctggtgtgaaaccagcaaccgcacaatggactggctgacctctaaatacagcgcggagcacaattcaggtcccttttcctcccatctcattggccatctggcttcaaaagggggtcggattttccgatctacaaaagggcacgtctgaattgatgtgcattttggagaggaggctggtagtagtgtttctgggggtgttgtacctgttctggctggccacgtttcaaaaggggaaaagaaaagagagaaggaaaggaagaataaaaaggaggggaaaaagaagtaaaaaggacaaaagaggagaaagaatatgcacacacacgtatctacatacatacatatatactgcactttctatcttctgcatccatttttggccccagaagtttctctattcaatgtacattttaatagggggccaatttctttgctccagatgaattatgttttctgttccttaatgggtttttcaaaaggaaagtaacaaccctagctatcagactcttaaataagagagagattacttttaacccaaaggaaaactatggcaggaacacagtctcacagccaagagagatccccacccttgagaagacaccttcctgcctgcctgtacagccctctcgcagtggctgcaggtatcaagggctgatcccatgctcccagagcgctaccaaggaagggtcttcagaaaaaaatgctcaggaggcaagggggctgcaacccgtgccacagaaagccagatctttctttgcaccagttgtacagtttctgcaaaactgaagactgacattgaaaacgactgctggtcagctattccttgatcactcctagagtgtgtatgttactattcctccaattgctagcaagcattgagactggtggactcagctttctgctggaatttgagtataatgagcatctgtatcataaataagcatcaaagatataaactataatctaaagaagaagccaggcgcagtggctcatgcctgtaatctcagcagtttgggaggccgaggagggcagatcacctgagatcgggagttcgagaccagcctgacccacatggagaaaccctgtctctactaaaaatacaaaattagctgggtgcatgcctgtaatcccagctacttgggaggctgaggcaggagaattgcttgaacccaggaggcggaggttgtggtgagccaagattgcgctattgcactccagcctgggtgacagagcgagacttcatctcaaaaaaaaaaataaataaataaaaggaaaagaggggtctcgatggtggttctcaaacattaaattacctaagaattacctagggagtaatacctggacagactgtattcccccagatatcacatgttgaacccctagtccaggtgtgatgatgttagaaggaagagcctttgggaggtgattaagttgtgagggcagagctctcacaaatgggattagtgcgcttataaaagaagaggcagaaaatcagttagtgtcttctttctgccacgtgaggacacagaaagatgatggctatctgtaagccaagaagagagcccttaccaagaatccaaccctgcaggcaccttggtcttagaattccaacctccagaactgtgaaaaatcaatgtttattgtgtaagccatccagttcacagcctgagaaaagttacagcttgttaaaaacacatatttcagagcattaccctcaaagattctgacttattagacctaaagttgggcctagtcttttctgaggacatttttccaatacctccttggaccaagaacataggcctcattataaacgagcagagtgggcctgaatttccaggatgttatatgtttgtggttgcctgtgaggatgtttgtgtgcacatgtgggaccagtggaaagtactgaaataagctgtggagacatcccttctctctctcctttttattaactgtggtacacactgaatatggcaggcaaagtttctaaaatggtcttctaaagatgcccgtcctaactccaggtacctgtgaatataatgagctatcactctgattatattatgttctaatgcacagttgaccttgaaataggatgaacatcctggattatccaagtgggctcagtgtcatcataggaacccttaaaagcaagaaactttctccagctgatgacagaaagggacatcaaagagagtcaaagtagcaggaggaattgacaggcctttgctggctttgaagacgaagggagcccatatcaaggaatgtccatgagcagcccatggtcaatagccatcaaggaatcaaggacttcagtcccacaactccaaggaagtgaattcaatcaacgagcttaagaaagtgtgaagcagatcttctgcaggggccccaaataggaatccaggctgtttgaccccttgacttcaacctcgtgaggcccaaaacagagaacctagccgagcccacggggcttctgacctacacactttgagataataaactgttctaagcactacatttttggtaatttcttatacaacgatagaaaatgactacacttcagaaataccaaatgaagaaaatagagccctgtcctttcggatctcacaaacaagagaggctgaggatgtacagccaattaatatgtaagtatttgttaaagggatgggcacaaggagccttggatatggaaaagggttcattcttgcttggtatgctaggggtgaagggagctcagcaaagctgtctcagagagagtgatgggtgggctgggtcttggaggaggcataggatttgttagggatggggaggatattgtaggaggaaacagcaggagcaagggcagagtggtctggaggtgtttgttacaagtggggaagaggagccaagatcagttgcagctggagtttgtaatacatgaacggtgaccagagatgattttggaaagtcaggcaacagtcagtatgtggaaggatttttcactgcatgccaaaaaaattgggcaatatcttgctttggtgatagggagtcctaggtgttggtaagcaggagtgtgactagtcacatttgtttttctacttggccttcaggcacacagaattggattaagtataattatgggttcatgtcacattctcatgactgttatgtgcaatgactttctttccttccttccttccttcattccttccttccttccttccttcattccttccttccttccttccttcattccttccttccttccttccttccttccttccttcattccttccttccttccttccttcattcctcccttccttcctccctccctccctcccttccttctttttttcctttctttcttcataatacaacgcatactttctaacactctacccaacacagaagccaaaacactgatgatttacatctactagtgtgtgtcctccctcttttatcccttatctattgatcaattgatctatcactctatcaatcaatctattttccaacctgcctatctatctggtattgtcagatctatgtaaatttattacctgtatattgtttaggtttcttttctttaatttagaagagaacattatgctgtttgtactcttttgtatttgtaactgtgtttgctaactttaatcctatgagttgcctgtagatgcatttcatccatttcgattgctggacgttattccattgagggtacacactgataaatttcttcattcctctattcttctgtctgtgggaatttgggagaattatgcaagagttctcttaatagaaaatacggcaccaatactaggacagtagatgtgggttggagaagagagagagggcttgagacttagataaactggctatgaccaatgttcaaaatgtctagcctgagaaatatttgtgttcagttcagattaaaactgtttacttctttctctctccttctgctgggccacatgttgttctcatgcaaatgcaagcttgcagcttgtctccccaggacagagcagagcctgtacctcactgtaggaggacattgaatgcatcaccgaatgaaggcaaaggactgtctcctgcatggacatacagtctcggccacagcctctggactctgctgacagatggctagtgatacttgagtgagccgtgagacctttagcgctgccctgcccttccttcatggggaaggagcctgtagtggaaacatcatcttgagatgtagaagcagcaggcacagaatatcttgcaaccgtaggggagaacaataatttttttcttcaatccccataggttcttagttgaaacagatccctataacaaaagacagactaacaggaaaaaaaaaacaagcagcttaacaacatgtgcatttcatatgcacacgagagccacttagggaatgagcagttctccaagaggtggcttttgaattccaacttacatagcatcttcaagaacagttagtttttagagaagcaacaagataatgggaaaggactttgattctctaggggcaacaatttgtgggcaggcaaataactggcagataaaggccagttagtaaagcttgttcatgtggagtccttgggtatcatctccagtagataagaatgtaaagttgtcttcagtggttaaccttcattcttcctagcggtggtggtgggaggaggagcagggttccttttgtctttgtaaatctatgtcctacttttaagcaaatagaggcagggcacagagctgtcgtgcatctgcttcctcttaattgtcttcagctcaacaattcttcatattctgaggtggcaaattttggtctcttacccagcctaacaggtgagaattggaattgattatagcactgtgcttctctgacactggccctagaccagttcatcacctgcagcaggtacaaataaatcccaccttgaggattcagtgggatacagggctctccttcacttactgtcctacgtaatacagaagagcctgactatacactgttgagtgtggcgttatgaggcggtagaataagtggcacttttgaccatcttcctaaaaatacattacaaaccagagtggtagaagagaggtttctaatgcttaatttttattaaaagttatccttacatttaatttctgtcaagtggaccattatgcttatgatgagtaattatctttatcatccttaaatacttcctcttcaaagaaaatgtttaaataaacctttataagaatacttaaatatgatatgcggtactgagtttcatttaataaaattttgccttattgtaggactggcataaattggatatgtgcattgtttgaactagtcttttgaattcattgcattattttaaacatttcatttttgaaatattgtacaccaaccaaaaagtgacataggttaaaaaaagaaaatgttcttgtgttttttaaatccaggagaggttttacctggaaaaaatgaactgcctttttctctgtaaaacagagcccacatggtgcagcaagttaagtgggctccaccggaaaaatggtcctagtatgagttctaccactacataatcaagtgaccaagaatcagttacataacttctccttgttttcttgttgcagaatgagggggtaattaaataactctggtgccaagtcccatgagaggtgccagaccagtttagatgtgcaaagtcctttgggaagggagccattgaaagtctgagtagaatgctagaaatatccaggatgctgtgggaaagtccaagtacagactgatttttttctttttttttttttttttgagatggagtttcactgctgttgcctaggctggagtgcaatggtgcgatctcgccgcaacctccacctccctggttcaagtgattctcctgcctcagcctcccgagtagctgggattacaggcatgtgccaccatgcccgtctaattttgtatttttagtagagatggggtttctccatgttggtcaggctggtcttgaactcctgacctcaggtgatccacccacctcggcctcccaaagtgctgggattacaggtgtgagccaccgtgtccggcccagacagagtttattttttagcattagaaaatatctcaattcacttttgcttttaatctaatctaaactatgagttgagtttctgtcatgtgcaacaccattattaaagaaaataaaacttctttgaggaaggtgtgttgttttacagttgattcgaattaagagagattcacattccccctctttgttttccaaccgcttccaatcccaatcttctagagttctgtagtttgtactagaaaagccaacaggaggttgaatttgttgctaaggaccttggataagcacaaataatagttttccttgtctacgccaggttttcccgaccttgacactattgacatttctgtccagatgattctttgttgaggaaggctgtcctatgtattatgggatgtttatcttcatccctaacctcaaacccctaaatgtcaataaaataataccgtgccccctccggagccgtgacaacaaaaaatatcttcaggcattgcccaatgtcccctgttaagtaaaattgtccccagtagagaaccatttttttagaccaagagtgagcaaactatagctcatgatccaaacacagtcagccatttgttttgtaaataagactataacagaacatagctatatttatttgtttacaaactgtctgtggctgtttttgacctacaatggcagcactagcaaccatgccaagaacacattaatcttctagtatacttagtcaacttttctagagcctttcaatgcatgctatttgcagaagagataacgttagccctatttgcagataagctcactgggctaggtgtggttaaatgacttgccaacttctatcagagcttggactataaccaatggctcctgactgcctgtcttcccgctttaccccataatgttggatgttgaagggactgtaaagataattgactccagcttcctaacaaatacaaggatcactattaaaacaatatacctggaaaaaaaaaaaagagaaaccactgttcattcagtttttaaataactttaattttagaaagtttttccttaaattgagcatagtcctgccttctggagttttatagcatgtcaactctgggtaaaatcatggaatctcgggaacctaaaaggtcattgactccaattatctatgcaatacatgaatctacaccagagggttccccgtgggtattattcaaggttgcagcctcaacacctgcagtaaccagggatcatggggctcacttctctcacactggccctcactattctgaataactgtgactaagaatttcttcttctgtggaagttgaaatcaggtcctctgtatgtactgctctcaagagtcatgctgccacttagactccatagaaagggcctgatcccatgtgcttgacacaaatttttcagctctgcttgatttagccatagacaaggtctctgttgaatattcttgtctccatgtttaccctgccagattcttattttcttaaataacatggttttaagaactcttgccgggcttgcttgtactgctgtgaatacaacttgcaacagtttacctacatctttctaaaaaaattccagatagtgtactaccaattatgtttcctaagtttgggttaactttgtttcaagctgtttgattatgtgaacttattacgaacttacacacaaataaattccctgttgattgttacaaaagctggagttaagcttcatgttcctcatcttctattttacagttatttcaggatttggtggcatggctttttatttttctcccttgaatatcaacttggcaagaccagctcataattctagcttctcgagatattcttgcatcctgcttttaatcttccaatttatttactatttcacttggcttcttatcatccctacttttttataattatgctttttatatctttattcaacacattgatagaaatattaaaaaggataaggctaaagatagaatcttaaagttatcactaaagacttccttccatatcaccactaattcattaatcaaaaacttttggtcacagttattaagttaattacagattcactccataaagctatgatccagactgtatttctttgttgtgttacaagaatattttaataatgctttaaatatctgaagactcttccacctcttacaagtgttctcacttccaagctgcctcctcttgcatttaggatttgcacattcatttgttcacccatttattcacaaattatccatttatctaataatgacaaacactttctgtatagcaaacattctgctagatgctggaatgacaaagctctgatccctggcagccctcttgtagattgccacagcaagagcagaaagaaggacgggagctgtgacagagatgtgagcaaactgctccccataaagccaactcccaagtggagggttgggctcactatggaggagacttctgagctgctccttgaagagtggacaggacagtagggattcaaaatgcaaaggcatcccaagaagagctcagctgtgggaaactctttggttgtattgctggatatgaaaagggactagggggaggcgagactttcaagggttcctcaaataactgaatttctgacctcttaccattctgggcattctcctctgaatgctttctaatggcatctagaactgaagacagtagatatcccaggggtccccaacctctgggctgtggaccaataccagtccatgccctgttaggaactgggccacacagcagaaggtgagtggccagcagtgagcattaccgcctgcgccccatctcctgtcagatcagaggcggcattagattctcataggagcacaaaccctgctgtgaattacgcatgtgagggacctagtctgtgctccttatgagaatctaactaatgcctgatgatctgaggtggtgcggtttcattctccgcacccaccccattcataggaaaactgtcttccatgaaaccagtcccttgtgccagaaagattggggaatgctgctttctactgtccaacttgtagagtatagagtggactaatgtttcacttggtctgaatactatatggctactgaattaaactgcctaggttctttgaacttgactcctaagttaggtcgatcaatcttgtatcagtacagttgattttaggaacaaaagtgccagacttcctaaatatgttcctggaaatattaacttgttgttatatttgaacagactgtgaacatcttttttattctagattctgttgttttgttaccttagccagctcttccaaatatgtaccattgcattttaacaagcaagtatttatgtccgttttcttgcaacacttgaagttccctgagatcagggactatatctacatatgttagagacaatgtgtatttttcttgaaaggacaaagagtaaataaatcctaatctaaatcagtgttctctgttaaatagaattaaagaatgcatttaatctcactaaacctgcccatacatgtagacttaagtaatctggaagagtaaatatgtttaagtaatcaaaacttgaaacagatgtcaaatagagattaatccatgtcagtccatgtccatgctaatctcctcagtaatgtagaaaattgctcagtcttcttgctgtgactccttaatcaggtgtgtttatgtgcagatcactcatatgaccagatatattaggttgggctccatgaaaattgactctcagatggagacttttgttcagaaagtgcattagggagtactgtcaggaagaacacctatgaacaggaagtggatcagaattggctgaaaggaatagtggacattgttgcagtcatatcagaggcctcagtcagtcctgtggagattctggtgcagcaatggccttcaaagttgccaccaaacaaagggaggatgacagatccttccactcccatatagccctagtcctagaagtgggctgtccctgtaaagtggagtgacctcgaatgaggcagcttttgtccactgagggcagttcccagagagaggctcagctgggagccttccacagcgaatattcctggcacctggagaaatacgttcttctctcccaaagggaatctggggactgcatcatggcatctaccacaatcagaaaaagaaaaaaatcagaaaaggacctcctgagcacaatctcggatgtcctctgaaattgtgctctgattttgaaggaacatattcctttcaggtctctttcccattttcattttagttgtttaccaggcagtagttatgcaccacaattgattgtcaactctctatgattcacccaatttcttgctctactaagtcacaagtggccaacactgtgtagggtctgagcttaattctgtagccaatggaatgacccaagggttcttggtcactgatgttattttaaagccatctttctgcccaagaggcttggagaactgaagatccatagtagaaggtgaaaaccttggagaatccaagagcttccaatgcaagtagccgtacagcaagatctcaacaatgagacagctctcttgacacagcacctgcaatgcacttgaagcatatgcagacatgtgcctgtcctcatggaattctctgcatgtctgtgaatatataaaacataaatgcacaatggacctcaaatgcaggacaacatatccaagaaaagcataaaccattttccccacaatcttttgttctaaaattgccatccgtgtatcaactgcaaaaagctgagtgatcccgccacaaggagatatgatacatgtgctaactattcaaaatgtctatgcctgcgtcttttcaccactctgtgtgggcctgggtctgcttccatcagacactgaactttttctggcttaatttcttcatctctctgtgtgcctattatttcaataaaagactgaaagagaataaaaatgcaaaataaaaataagcatgtgcatcccagcttctacaagcaattctagagttttaagttttacctctgaaggctcaaacacctttgaatgctcagttccccaccctgccttccaaaggaacagagattctgtctaaggacaggttcattaacaaattaatagaataatcagcagggctttgtgtgcattttggagataaaaaactggtaacagcattctttgactctttaatggggcgataagcaccaagtatctgctctgtggctgagctaatcacacagataagggaggttaaatcaatccagagttctgctgaggtcatttatagatggagctgtatcctgcaacagcataaatagctcagttattttgaatataaccacaaattgctaaaataaacggagggtggggcaacaaagcctaaaataggttgtactgtgctatgtgagacagagtccccaaggccacaatctgtgggcatgtacctgtaaggctgcctgataagtttggggaaaataaagctctaggggatgtctcctcttaaactggtttgacatctggtctcaaagtctggaaagaaaaggatttttttctcatgcctttcctctctcctgttttaaattaagtgaatatgattgctttagagggagaaggattaacagttcaggtattttgcagacatttattaggtaggcctcctgcttatgccacaagcactacaccagcctaggtggccccatgacaggtatagcatgagcctactgcattctgatataaccttcctggccagcacttcatgcccagttaccctggtgtcactgctcctgctagagtggaaggcaggacctgctgtgtgcatggggcaggcgttgtcaggccaatgtctaggtgttcacacctcacagtgcagaaaggtgctggaacaattctagcagaaaaagtggaagtggcagacatgtgggatcagggaagggcactgaccaccttccagatggtgtgagtttcacatagttctggccagtggggcatggttcggccagcgactttcaactttcaacagcaccctatagcaaaatttgtgcaaagttcccgagttattagttacaattggggtaactgaaaaacaagttatgatgattaaggagataaaactttctttcttgatcctttaaagagctcacttattcaaggtcttccagttgttgcaggactttttttcagttcagctaaagatggggttctttgtcccatggccaagaaaattcaggattgcagaccatttcaatggtagtaagatagggttttattgggtgaaaaggaagaaaaagggaaacagggaatctctctcaccaggccagagtccctgctagaacacttcccactggcagcttgaatcccaggttccacgcaggaagacgaggggccaggctcctccctactacagatggcgcgaacttcccaaggctcgacctcagtaggttggagcttctccagggatctcctcccacctggctgtctcacaatgaccccatgccagaaaccctggtctcactgttatgagcacactccattcccggtcgcccttaggatggctctccctacgaaggccacactccgctcagaaggaaaagagaagggcaaggaaaagagacatcttcccttttagaacttgtcctggaagctgcacacatccatgagcctaaatttagtctgagggccacagctaacccaaaggatgattggaaattccaggattctgcaattaagtgcaaattaaaaatagatcctaggcagcaaagagcagcctctttcccccagggccagggaaatgcccatctcctaattgaaggagttcataaaataatgtgattcaatttttaaaaagaaagaaaagctttttaaaaagaattaacagaaaagataagaaaaatctggattagatgcatttaatatattgataagtatccatgcataacagtttttttttcttggatggctgagccatcagaaagggcggtgtgaaggttaggaaaacatctgtagtccctaaggaaagggatatattaaaatatttttcaaaaatatgtcttagctatggaaatgcagaggagataagctgcactcactctaccaaatatgacctgccctacctccctacagagaaaaactagtacctaagagctgtggagtagcaggggtagaaaaggagaacatgggtgttagggtgaaaaagcattaatgtagacagatatctgagaaacggcatttgctgtatgtgtctacatcacatttactgtcatgttacttccaagcaatgtgggggaatggatctagccattcattcattcattctggctattgattcattcatgcactttttccactatcaatcttttaaaatcgtctctccccaggaattgtggttggcagtggggatatggctgaaaacccgggctagagagattgggtggagggtcagtggtgcaggagcaggcagggatttcattctaagtttggatttcattctaaacttcatgggaagccatgaaggagtccaagcaagggtgtggcattcatgaaagcttcccaggctctcacggctgccaccaatgctgagaaaggagggatgggaggagtaagagtgcagcagtccaggtgggaaggaccatgatgtagactagctcggtgcagtggagggaaggggcaggcaatggagaagtccacagaagctagtgagggatacagtggacctagacaccacagctcgttgatttctgtcttggggatggtgtttgaactgactcccgtagatggagaggggcaggttagacggagtgtggtggaaggaaggcagtgtgatctcgcttctgagccagcgtccatccacgcgtccggtgtgaaccttctcagtagacagctaaagtcagctagcaccaaggcaagccctgaaggagagcgagggcatggtccctcgccagctggcctcccgagcagctgttagcagtgggggcagcaactggatcagaggagcagacccttcgcatggagcagcagtgcctgcatgggcattggcaggcagtgtcaggacggccaagaggtgcatggccaaggccgacctcggtcgtctgcagagggcatcttcagactggcctctgtgtcccctccaccaagcacacctcagcctccacatgctgccttgctgggacttggctgtcaattgccagatgatagacacgattccaacttcctctgaagagagagcagaaccattaataaaacatcaacactacaggaatccaaaggacccacaaaataaaataaaaattaaattacagctacagcaaaatcacatttgctttcctctggcaagcctctaaggaggcagttacgtccccaggggcactggcaatggaaagtgactctcaggcaaggcagatggaggaggcctcagatgagacggcagaggagtgagacccactctctgggctgcctgctcccgcttttgagatgtgtgggtgtccaacttccttccaagctagaacacagctgccagcccctgctctttgcctcttcgcttcctccttcccagctggcatttccgcctgactccagagcggtgagagacgtgtgccacttcctcggggtgcagggacttctcgagggatctgctgcccacgggacagtgtgccgggtgctgccagcctgtgtgaccagaagccccaccgggattggcggggatcctgacaactgtcaaaaggggtcgagggcacacggtggatggcaaggatctgcattattcatttatccgctgtttggagaaattgtgtgttgggcccagcacaaagaacactctgggtaatccactgctcagaattcagcctattccatggcctccaggaagtcagatattcaagaagtagggactttaattcattaccggaagcaatagaatgctgggtattttgtttgtttttttagtatgttccacaaaacaatagaatattgtggtcatctgaaaagtactctccagccaatatccaacttctaattcctggaacttgcgaatgtttataacaaaaagttcttcacagattgattaaatgaaggatcttgaaatggggagatcatcctggattatctgagtgggccctaaatacagtcacttgtatccttacaaaagggaggccaagaggtattttacagcacagatgaagacagcagagagagatttgaagatgctgatctggaaggttggagagatgtggccacaagtgaagggggtggggcagccagcaggagctctaagaggcaaagaaaggcttccctggagccttaggaaggagcaggaaggcacttgatatgggctcagtgatgctgaattcagacttctggtctccaaaccatgagctaataaatttctattgctttcagccaccatgtttgtggaaatttgttatagcagccacaggaagctgatacaataccattgatgacattttctcaatttaaataaacattcacttaatgaagcaaatcttcttcaagttttctgctgtgtttttcttttcaatatctggcatatgctgctgtttacagatgaatgaagaaattggacttaagattttgtggtatatcagaaaagtcactgtgacttttaacttgcatttttccccccactgatatgaaaaagagaactacaattcctggagttgttctaaagttcaaatgaggtcaagtggtgctaagaagtctccaaactgcccagcattgtgcaaagttgagtaaaaggtcttataggattggtcaactgatgacacaacctacgatcaatctctcttctcttcccacccccccctctctttcctttgtccttcttctctttcctccttctacttctccttccctcctctctttctccctatacacattcacacccacacatatattatctatagaaaaaattccacttaaaggtgaagaatagccttatgattatgtcttatatttcagtaccattttaaagcttactgagaacttttatatccatcattgtatttattaatcctcatgctacccctgtgggcacacagaactaacatcatcctccttatttgatagataaagaaagcaagaaccccctcggtagaaagtgttaagaggcttactcagggcgacatggatgtaagcggtgagacaggattcaaacacagatctttatgaatacatggatgcagaactgaaaaggcattctcacctgtctaatcagcaaggactgagcaaggtgctttctgtctatacagacctggaatgaaagtctagtcttgcacctcagcagctctgaaaagctgagtggtgaccttaccctgttgaaccttccttagccatcaaactgggaccatagtacaaactttgtgaggctgagtgaagattcagtggaataagttaagggaaagtgcctagatccattcctggccccgagaattcttctttcaaaagcaaagggcttttgtttttattttatttttatttttaactcctgtcttgatctcaagagagtcaatcccagtctaaccatctgacctatttattgtatcactttcaaaccacttgtgtttgttttctctctttctgtttgtcaaaagttaagttcaattccagccacttgtcacttaaaagatgacagttattactcatagctacaaaggcacttatggcaatagctgctctgtactgaagcaacagcactcacaataaatactcttgccagatcatgaggattttgtcaagcacatccctctcagccattgctgcacaattatcatgggtgcacctagagttccgctgagagaaaggggtcaatacttgagtgatctgaggctgaggcaatctataggcctttgggttttaatcccagttccctcattggtctccactttgggcaatgtttgattgaagtacaccaggaaggctggtactccagatggcctttgccacttattcttcattggtccctctgaatatgtgacatgataactcctccactttccaagtggtaagaaaacagtcagttattggctgggctttggctagcaagaaaggcttggcctggactatggctatagttctatcacaaccagtgaccatggtgctagggaaagactaatgctaaagtcacccaatgatagcatccagatgaaaaacatagccttcttctttatcatttgctgagattccttctatcagtttagcttaaaaaccagagaccagttcttttgttataaaggttcactcttaggaaggaaggggccatgcattggtgtgtctgtgtgtgtgtgcacatgtgtaaatgtgtgtacctatgcatgtaggcatgtgggtagtaaacatttgaaatagggactccaaccctgttgacaccatactaattagttattattattgtttctttttaaagacccctgtccaaccatgtgtcagtcagtttgcatcattattaaggaataactgagactgggtaacccataaagaaaagaggtgtaattagctcatggttctgcagactgtacaggaagcatggtgcctacatctgctgtcttctagtgaggcctcagggagattttactcatggcggaaggcaaaggggaagcagtgtatcacatggcgagagagggagcaagaaaggaggcaggggagctgccatactgtgttaaacaactggatctcacaggaaaccatacgagaaggactcacttaatactgtgaggatggcaccagatcattcgtgaagaactcgcccccatgagacagacacctcccaccaggccccacctccaacattggggattacctttcaacatgaaatttggaagggacaaaccatattaagccaatctagcattatttttttcccaggaacatcttttttctctaattgtggtcattggcctactgtttaaatgaaaagagagtgtggtttctatgccttccttattacttctctcctccatttcagatctctgcacacttcctggaggattttgtcagtgtgagaaaggataaacccagctgcaattatacattaaggatttcctccagtagagagcttgtgaggggcattgttaaacatggcatactgcctactaagtacttggcttggtcaagggtattgtatggtacatctgtaactacaggtttatacttagaagttctgacacactttcaggatgagcgcggtggctcacgcctgtaatcccagcactttgagaggccgaggcaggctgaacgcttgaggacgggagttcgagatcagcctggccaacatggaaaaaccccgtctctattaaaaatacaaaaactcgttgggtgcggtggtgcgtgcctgtaatcccagctactcgggaggctgaggcaggagaagtgcttgaacctgggaggcggaagttgtagtgagccaagaggctgaggcaggagaattgtttgaacctgggaggcagaggttgcagtgagccgagatcacgtcaccacactccagcctggccaacagagtgagactgtgtctcaaaacaaaaaaacaaaaacaaaaatgaagttctaagatatcctcctttcttgtcaacttcattttttatagatttggctcagcggtgtgtctacacaggaaagatgggtttccaggtctggtgggctgagtgcaagcaggcttcctgaaacaagctgcctttgagggggatgcgttttgggtagaggttgggctactttggaagaaggtgggagaaacttccacttcctgccctgagatagacccctgtcgcctttccacaacgttgccaacagaaccacctgaagctctactttttgctgtctcgtagctcttttcttttggagagactccagctgtttacagcctggctggcagcctccttggcgccggagttcctgacatttctgatggccgcctctggctgtaccacacaggcacgctcgtggcagcacgcagagctacaagaaaaacctaaatttaaatgttaaaaagcttttgttcattaccggtggcattccccccccgaccccatttgtcacttggagcagagctgtgactcttttaatatcaaacaaataataagctccctctaaagtgatttttctgacaaggagctcaatatattaaactttatctatattttaatagccaatttcacaccaaactgccttcttaataatgtatttaccacctggggatattattccaacccatctggaaagaattggaaattaactatccccaaaccgagtctgtgtgtgctttacacttgctgtaggaaacggcagtgtcattgctagggagggggctggggcgagagggggtctcgccacctggggagggtgagatctgaaagagaaatgatagtaggtttagagacacgaattccttctccagaggcaaagctcatccctatgatgagctgagaagagctcctgccagatagggcaggactgctgggagcaggaactagtcccacagcattttaaagaaatataggactttctttgctagcaacctgcagctagttgacatcacacaaggttcctatcatctgaccttttgtttcctcatctgcggaaagagggaatttggctagatgacttcagaggtcttctgtgtatatagttaaggtttgtcttagtgtgtttcggttgttataacaaaataccataaactgggtagcttacaacagaaatttatttctcatatttccggaggctggaaacccactccccaggcatcaacagattgggtatctggcaagggcctacttcctggttcatagatggcattttgtcactattctcacatggcagatagggtgaggtgtctcatttgggccttttataagaacacctatcccattcatgagggctccatcctcatgacctaatcacctcccaagagcccccaccttcaccttgggggtcaagatttccacatataaaatttggagggtcacaaacattcagagcatagaagagttctctctggaaaataccttttttatgcctaacgacaacatgaattgtgttggggattgttttttcccctttttggttatgaacatctatgaaaactgacaaagatgggaggccctaaagaagttaaagaaaataagacacctttagagtagacagaaaaacttcccacaggggaggggattggagcatgagtaggcccagagtagccatgctaacaagtaaacacagtcaacacaggctccccccaagtgagaagacagggagaaagtgcccctttgcctcatagacttacacatgtaagccactgggtgaactctgctcaatgcactcagctagattcagcaaacactatcaaactcaccctctaatgtgaggacacatttgcagattatcacatgatggtgtcatgggctccctcatgagtggaaccgtgacagaatgacagactggggatgtttcttgggggactcagcagggctcaccaaggagactggacattttaactgcaccttgaaggatgggcaggcagccgcaggacattccaatcagatggcggaactatgccaaacccaattttgtggcatatgacaggttagcaagagaaagaatgtttctaggggtcaggcaagttcttggtcccaatgtcagcaggatgtgaacctcctgtgagggctaaaaccaacgagttagggaccctgaagggaagacctggctttaatgaatctaaggatagaaagtgtgtccaggagaaccccggaaaaagtatcagctccaagatgtgcttggtatagtcaagattccaagagtgaaagaagcagctaactctgcgaggaaggaattagtatttgtggaaaacacacaggctcttggaatcaaccaaaataagatgcaatgtgatgcagctcctctgggcagccccagccaggagtcttctcttgagagtccatggtggatggtgatgagtgtcccttccatcctcccaccaccatccacgggtcttgctcagctccctgttgcctagggagcacatgagccccagcattgcggcgtggatggcatgtgcatgcatacagcactgtctctccagctgtgtccccagtcatatctgggatgtgccaatcagatgcagatgaaaagaatagcgtttccaggaggaacagatgacagggcatcagctcactggtgttcttagcagagggaagtgtatttgattcaccagctcagaacaaaaagatctacatgggaagggaacacctgatgagatatttggtggccggggctgatagcacagccacagaaaaaccagaaagcagtggtatcagaaggctgccctatctaatcctgtgcttccattccctttccagagccttgggagcaagatatgtgtgactcatgtgcagatacgtgtgagggcgagggcacaggagtgatggctatctcccaggtcctggggacctagagtcccaaattaataagcagacaagaagactaactgtgacagacaggtcaaggaggagaggggtaaaaggctcctttaatcctgcagtcggaggatgtgcaatgctgacagttacctggggacccagagataccaggctccctaacttaatcagacagataaggggagctgcctcggcagaggccgcaccaggaaaagtggaacaataggagacggccccttaggacctgtgctgctacagaaataataaactatatagaaatctgtcactgagcgataaatgatgaattagaatcaattatatgtttaaaataatagacatccttgtcttccctactggaagtggaatggttttgactggccttagaggtgccaacaaagcagggactctccatggagctgtttgtgccaggcacactaaaattattactgagatagacttttctggccagattgtcttgttttgtggctccggggaaaaaaaaatacatagaaagttatgagtcaagtattttttttttttttttttgagatggagcctctctctgttgcccaggctggagtgcagtggcgcaatcttgactcactgcaacctctgccttctgcatcccgggttcaagcgattcttttgtctcaggcttccgagtagctgggactacgcccagctaatttttgtattttttttttttttttagtagagatggggtttcaccatattggtcaggctggtctcgaactcctgacttcagatctgcccatctcggtcccccaaagtgctgggattacaggcatgagccactgtacccagctatgaatcaagttttaatctttatccctctttgcacccatacatttgccttcaaatcctgtatcagaaccaaaccatttgatgagcagtgggagtaaggaagtctcagacaaggtattttctctgtgccttttctttttcagggggcacaacatgcttaataaccccatctacaatgaggacagacattggtgaaaaatatgctaaagtctgtgtagaactctccttcaaagggaattgctattgaagaagggacttgcgtgctccctaggcagcagggagccgagcaagacccatggatggcagggggaggatggaagggaccctcatcaccatccaccatggactctaaagagaagactcttggctggggctgcccagaggagctgcatcacatttcatcttattttggttgattccaagagcctgtgtgttttccacaaatactaattcctgcctcgcagagttagctgcttctttcacccttggaatcttgactataccaagcacatcttggagctgatactttctctggggttatcctggacacactttctatctccagattcactaaagccaggtcttcccttcagggtccctaagctggttggttggttttagccctcacaggaggctcacgtcctgctgacattgggaccaagaacttgcctgacccctagacccactcttctaggggtctttaaaagggaagtattgaaggtagatttttggcatttatttaaataatctaattcttttcctcaaagttttatcccctttatttccctgctctccttcaatcatatgagcacaatcaacatcaaagaaaggaaagaaaaaaggaaggaaggaaggaaggagagacagagggaagaagggagggagggagggaaagaggagagattttagcttctttttagcattttgaattccaattccaactttccacatcctcttttattattatcactactactccttctatgactactaatactatcattgagtaagagccttagcccctagatgtaagtttgccttcataaacgagcacagcacagttcatttgggttgtcatataacccaaatataatatcctccctctgactcccgtctgcctagcaaacttccattcattcttgagctacccgctcacgtttagtcttcttggcaaagctctctctgaccaccatttccctccataatatgacacattctccctttctactttcttagttgcagatgtacgtatttggttatgctgcactcatcacagtgccctggtagagaggaaagtgatggttacttaggggcttgggtttcatagtcagctatttaccaaccatgtgacctataaggagttattcgtccttttagagtctcagttttctcagctgacacatgggtatgacaataacagtattcaactcctaggggtgctgtgcacattaaatgaaaggaggcatgtaaagtgtctgtatccattaagcgttcctgaggttcttataaccttatattgcttccattcatttgattatatgtccgcattgttcacaagaatgtgaggatcttgagggcaggggctgtgttccatttagctggtataatgccagcaccaagaacagagcctggcatttggaggcagctccgcacatttaatttaaactgaactgaaacagtgcagaaggcagagttgaagtcaggtaccggtgggtgggtggtgtgtcccctggggccatgagggattgcaaacgctgcttacaggtgaaaatccccgccctgagccttcagcagactcagtactaccttggccccctcgaagcagttatttgtgcctggtcgctggaagttcctttccaggcagccctggtacccacgaggcgcctgcacggcgagcccccagcagctcctccggtgaggccgccccttttccccagcccttccctcttctctcctaggctcctcctccgtgtactcacgctgacctggtaggtttagtcttttgtgtggtcctgtatcaaaagtttaattagaaaatcgcgcctgggctttttaatagcccgagttccggccgtaaaagccccggacgtgctcccgcgcgcgccggctcctggcaggagcgcaccagccgctgcggcgcggggactcccgccctgaatcttatttacattcggactaacaatagctctggaacctggctataaataatttctggggaagggttgtctaattaaacgtgcagcagtaaggaaagtgctttaaccacaaggctggtgtcctgatgaacgtaatcactggatggggacagcttgggaatcacatccagacgtctccctgcggaggtggagagatgcggggaagaatactcagggagactttccaatccatatttaattgtgcagtgtgttcaactcgttagagggcctctttttttccttccctttgcccatacccagaggtagaaaggatttcaaaatgcagttttgtggggcggcctcagcctcagattccggggtgggggggtagttgtcagtggcctgtcaatgtctagaaatgatccgaacacataaaatgtattaactgataagtagtggcgcttacaggtgctgaatttagagacaaaggtaagggtgattccagttgattccagatctttctctgtccctgtctatggtatttccagactctaggctcgcggagggcaggggctctgtgtgcagtgtgttctgccctttgtaagtagggagcggggcagcgcatccaccaccctggagggcatgaagaaaatgaaatgagtccttcctgcctggtgtcattcatggagggtcagccacgcctgctggcatctcaacggtggttagcaaatccagggggatgtaagcccaaggcatccatgctcgtttctgcttcattagaaacagacaatgtaacatcaaccagatggaaaaggacacaggatgcagggtgctttcccttctgtgttcctattaatatgctcccgaggacagaaagggcgccctgggaggaagaacagcacactgtcatactgtgtgtgagtaacacaggattcacatgtgtatacagattgacctagaaacatagtaagcacatgcatgtgtatgcaaacctcgggtgggcagatacctacgtacatagacatgcacgtcctggagctgcactaaggatgacatagttatattgctatggtaacgtgcatgctcttgaaaccaaggcaaaccagtggaaggagggtgggaagcaggagctggggagggtgtggatctgcagaggagcctggggctgaactgcggcacaaactcctaaccagcactactaaccagtgcttgtatcctagccctcctcccatacacggagatgaaagagcaagagtgggggcacctgtgattaatcgaattcaccactggatgtcaacgttgctccagccagttagaaaacaaacagccattccaataatcttctgctggtaacaaggaagtttgatccttaggcagcaatcagtttatggtatgaatgtactggggaaggggagggttagacaacaaccttctgatagaaccccaaagggaaaattatcaaattctaaatttgtcatttttgccctttaatcataacctccacgtttcctctagcaccccttgctccccattcattattctcccttagttaacacttcctagtggaccatccaatatttccatttagtttgctcattgcctgcctctccccgatacacacacaagaataccaactccatgatggcaaggaattctgtttttgttccgtcgcaccctcgatgcttaaaacactgcttggcaaaaagtaggtatttgataaacatttgttttaaatagatgcgtgtataagtaaatgaattaatgagataatgaaatgtggtcaatgaataaaaatggagacagatattattgcaatatgaataggagtttctctttcttctctgcaataagtatatatatttatttttatacatgtatatacatatatttcagagaagaaatatatgtgtccggatgagtgagtgtgtatgtgtgtgtatatatatggctggagaaagaggtacagaagcagttgcctaaacacctgaaatatcaggtttggaagagacttgaagccaagccttggagggctttctgagttgagttatatataactctgcttctatcttgttttgtgaacttgggaagataacttagcatttctgaaccttagcttcttcatcaatacaatggcttcatcataataatattggtccaacctactccttaaagatccatgagatcaaatgttacagcattaatccacaatgtattttgccttgactaatatataccatatcctgcccaaaccctctcacacatgctgtaaacaccgagatcctacacagacagtgttggcaatgtagatattataacccttttctggatatgaacatggaaatcataaacattttccaggtatttcacttaatccaaaggtcttaactcttaaggtaaactgcagggaaaacagggatcgggaatcaaccttggggtggccacatttcccacccagcaaatgaaggcactgggagaagagccttcccttcagacgcctcaggtttgtggctgtttctgtatcttctgttttagggctgtgttgaaggcctgggctgccatggcagcaagctagcaacctgccagatttatatgtttaagttttaataaataaattaaattaagcaaaaataggtcttcaccgtagagccctttcaaattatttactgtgctgtcactttgggctcattgatgctcgttaatatttcaaatttaatgataagcaccatttataagctaaataagacattagttgcattatactggcagaaatgtacaaggacaccgctaatctaaggtgaaaatgcattattgagtggaatttaattagtagattttgttctattaggggcttgtatattgcatttatgaaaatgaatacaaatatgatccaggcaatctttccagtgagaaaatgtcactgataatctaacttcactcctactctttaaagcagatgcaagatgaaaattgatgtcctgttctcttgacagtcaaaagattttctagtttgtggttctaataatagctaaattatggggagatgccttgtgtgacgctttggcaggtgtgaagaagtgtgtccagtgcgaattgctgtagacatttttcttatggcaatcctatgggcagtacatgtcagagaattaggtcagaattatggtttgcttagcgggtcaagtctaatttgtctgcattatctgctctgattcctctatggggcaatatggccttaggagaaaaggcaagacttggaatcatatacctgtgatttcaatcatactttcatcatttataagctttgtgcaatttattttcttaaagtaagtacataagctaccacattttatgactccacccagtaatccagtgaggttagttaccattatgaactctattttatagatacaggcaagagagactcggaatgctcgagctacttgctctaggtcacacaactaaaatcttcagttctctgcattttccattttcttatctgatgatggaggtttgccatatatttaaaaagtgtattcaatcaatattagtctgggctctctgtttcctccagtttcttactttctgggggcatcttggaaaggacatagagggccagtgaccgcaattctcatttctaggtgaccaatgtaaagtctttcctgacctcagctctctcatatgacaaataggaaaatagaatgcctacctttcctactgaagtagttgtgaaaatcagttggacagccatagtggggtgttgtacaaatgtaaagtgttagtgttatgaatataggcaataattcttttgattctgtgctaaattgcattgacagaaatgttgagagaggagatggctgagattgacgctataggagcatttctttgcaatgagttatagatcgatggtaagtgcaggcactctctgagttacgcacagctaacttatcaacattctgtgcacacaaaggactcggtgcacgccctgtaggcacccactaggacaagctgtgcttcagattctgtgcctctggaaagcatctttctggaatgaccccgcctgctttcagtcatggttatggcactgtagctgctatggattgctgtctgaaccaagctttcctctccactagctcctatgttcctacgcagggtggcatgctcctctgcctgagtcttgggattcagtgaacttcagcccttctaatccacacatacccttgcatgatgttgatccttctgcctttcttttcttgatatgaccttggtacaccaggaaaatcatccaagggtgataaaataaatgtatttgttaggaatctacctaagttaatgatgcagtggaaggctttattttctttgaaaaccaacctcatatgggtaagagatgtttgatagttcaaatgtttttattttttaaatgaatctcaggtgcacagaattgtattatttataaccagtggcccatgatacactctcagtattctatgtttgagcccctttttatttttatttaaaaaatagtatcataagcaaccacagatccacacctccacctctgaacacacacacacacacacacacacacacacacacacacacacacacgctctaggaccttggcatcaacctgcatctccagcgcatggtcctcccccatccatcctccttcctgcctcctaccttagccatcattcagaattccatgtgtatcttatgcttccattttcatataattgcatcacatacatatgagtctctaaaattattcttttaattttggtatttttcatcttcataaataggacatgcattttttatgtgtgatttggggttagttttcacttatttatttccaagattatccatagttttgtgtgttgctgtagtgctgtggttcatttgcgttggtggaatagattattctaatttatgaatattcctcagttgatttatccatttttatgttggtgactaggctgaaccaatgattttttcctcttgtgaacagggttgctatgaaaatatctgctgaggaatggattcgctgggtcacagagtttgggaatgtttaaatatggaaggtgttgccaaactgcctaccagagcagcaccttatcctctcaccagcaatgtatgaagatcctgaacattcgcagcttctccaatacttagtaatgcccggcatttgaatttttgccaatggagtttgggtaaaatgcaacgttattgtagtctttaaaatccacagaatatttcttcctatgtgtttcctcctccctgctatgcttgttcatttattttgcccattttttgactgtgttgctgtgcacttctcattgacttattattagaagttctttaaatactcttgacattaatttttgtcagttatatgaatagctccattttcaatctaattgagataattagtccagagactaaaggaggcatgaatttattttatcctttgatcaaacaaacccactattcctgacctcacctcatcgcctttaatcttctattctgcaaaactagcagagggagtgacattgtgtcagaactagagagaaggctgtattcattagtgcattccaaggggaacaaacagggcgagggagacctaaagcaaaagcttcatgttatttattctaaaagaaggccgcgcagccctccccatttctgtctagctttaattagtggacattcttgatgcctttactatcttctcagaaagtggactatatttttccaaagtaatcaaagaattacagaggagtctttctttccgtacttcccttggcagagatgagacagacattggaaaaagcatatagggctacattattcatgcagatgagtctcacaattcaatggagctaattaggaaaatgatggagtaaattagcactttatgcaagtgtattaatattaataaaactgccattttaccctgaggttaaaacagaggaggagaaaaccacagccttgaccagtgagtcaactctcagcctggctgcttactggaatactgaccaccctcatccatcctgggtgatcttgttccttttctgtcatcaaagttgtcctaataaaaaaaagagaactatttcaaaggcgtggatgcgctgtccttgttttattgttgtggttacttgaaagcaaattctgcattttctttcttgttgagtcataactaacagcacattcttgtttacatggtaatttcaaatccataatcttatttaagttttgcaactaacttatgaggcaaagtgctgatattttccctatttataatttaataatttgtccacacataagaaatgataaccctctgagtggactatgagaagaaaatttgagcattccttgacatcagttttgtgggggaccagggtgaagggaggccttggggaaagaatgatttctatgctgatgccctcaggagctagttggtggagcatagggaagacgctatgcttcctttttctccacgcattcattcatttctctccatatccattctcatagccaccgctttggctctagcaccatcctggtctccactcttgccccctaaaatacattctccaactgtggttagagtagtcatttgaaatcacaaatctgattgtgccaccctagcccagctatgagccttttgatagttcaacctggctttcagaattaacacaaactctctcgcaatggggcctttcacaaaccactagcttacctctgcatccttatttctgtctggtcccactgtctccatctcttctttcatattgcagccacacggaactgcttgctgccccaggtacacgcagaggccccttggtcttcacgttcttacatctacatgaaagcttctcccctaggctccattgcctggctcctcaggttggcagcgtagaagtcattctttccccggtgcttctcttcctccctcccccttacaaaactgttgtcaaggaatgctcaaattttcatctcattgccctctcagtgggttgtcatttcctaatcactatccagtcttctccacaagacagacagtttctagaggacagggattggggcacctagcacattagttgtcaggaagtgttgtcgaaagaagaggtgaagagggagagcgtggatggatcacatggttacttagggtaggaagagttagaaacccgtcttgaagtcctgtgctccctcccacattcgcatcgtctcactggctcatgttcgcctcatctcactcagagtgctggcttggataacctgtaagagtattcattaaaacgttcaactttttcaagactcattattggaattcattctacatcttctgtagatatgcttaatttgcttccagagggtcatggaatctatagggaacttcctattttagtttactggattttctttttccctgatggtaattaactctcgattacccattctcattttagtgttttaaatcctgaaccaagtaccaatttccatttaaaagaagaaaatctttctaaaggcatacagatacagaacccttacaagcttaactttctatattttttccaattatttccaaattatttatttgttcgaggattccttgatttcattcaaaactgtttattgagtaggtcacctattatggtccaggcaaagtgctaggtgcttattctcatttaggattgactttgataataatcatgcacattcctaaatctgggatcctgagatggtcctaagtgtgttggagactgacttctctcctactctattattgaatgtgtaaaattcagtgacttacttaaccttaattattctgtttcttcacctgtaaaatgcttattatactttctttcatatccagattgtttactttttactaaaaactacttgaggtagtttttagtaaaaaaaaattgagatattttctctaatctcaaggaatctagtcagagtgatagatgagtaagtcagtgatttttctgcaataaaataatggcttagttagaattttcaaggaaagctatgggaagactggaggttttatgggtatttccattagattgagggaaagaaagtaaaaaaaagttttcagagctgatgcttgatgtgagttctaaaggatgaatgacagtttgctagagaaagaagaagcatcataaacacattccaggcagtggtaaaagcacatttcaacaggctgatgtatgatacagaattatccttttggaaaaaataagtagctcagcatagaacacaaagaaagaaaaacttgtgaaaaaggtagaaatgaaaagccagagagacaattggaaaaccaagagaaaatacattcagactagcagaacagaatgatttactgcagggaaaaggaagaataggcctattaggagaagcagagaaaagcagatttgaaaatacggaggtgtgataggccgaattgtaagatggacctagtgcaggtaccctgtataatcctctccttttgagggtgaacggaacttgtgaatatgagaggatttcactcctatattcaggctacattaaatggaaagaagagattttgcatcatatgtgattaggtccttcaccagtttattttgaatttatctaagggaatattctcctggttaagtctgacctaaaaggtgagagccctttgaaagagagaggtgtgaggtgactgtgctttcttttgctggccttgcagaagcaaatgaccaggttgtgatatgccaatggagggttctcatggcaagaacctgaggatggtgtctagaaactgagaaaggtgacttactaacaaccagtaagaaaatgggaactctggtcccacaaatgcaaggaaccaaattctttcaaccaccagtaagcttagaagaggactctgagcctctgatgagaactacagccttggccaccccagaccttgattttggcctggtgatgtcctgagtagagtgccttactaactcctactcacagaaactatagaaaaacaaacatgttgtttcaagttgataaatttgtgggaatttgttatataacaataagaattgaacacaggaggccatgggtgtcttggctagggaagttgcagtggaactatgagaatgaaagccagattatgtgtgctgaagagtaaatggaaggtgctgaattcatgctgggtagatgagagtaaataaacagccttcttaatgtgatggaaggagcaggtgttctacgggggaacaaaggacaggagggtagagaaatacttggtggtttggctgagcctgtgagcgaatttgttaatcatggatacaccacgcgtaactccagggaagcagaggaagcgggcggcagggtgaacagaacactactggggtgaaaatgcgagacagtgcaggtcactgaaagttctcaggattcttactgtaaatagatagtgtcttcaagctgttgctggtggtctctgaagcttgcagatgttcactgtctggggtccaatcagcagtcagtggtctttggttagagttctaagaaagatgctggtgtgaggttgggaggaagtacacatagcgatggaaaatactggacaaggttctgggaccatcagagttacagctgtggctgccaggcagcttggactagttaacattttaagccctgttttccttttatacttacgaaaagggaaaataatgattaacaatatctattactaaatattgcaaggataaaaaagagaataaatattgcaatactttgtaaaatttattagtatgtcttattcagtgtgccagatagtaagtgctaatccttatttccccaaggtcccagtactgaggaatatataacatattgattgccattatattgtaagtacttaataaatatttgtgaaattcatcttaaatgaataattatcgagtagttataaggactctaagaaaataataagtgttcaatacagcttagctataattgtaagttgtcttatgtctcagcagacctaagccttgggtttagatggtggcatagcatactggatccgggtcaatgaaatagtcactaagctttctggccttgggaaagatcacctgcagggtcaacctaaagcccattggaagcagatgctttcctgaatttcactcttctgtaaaacttagttctagtagtagaggtagaattatgagacctctatcacaatgtggccctccaggaaccttctgaggaatccagacaatagtaaactcaatggattagaacctgacaaagtggctggcacaaagtagtacttactaagaaggaaattacttagtgccttctttaatctctttctttgtttttcttcacttttaccagtagaatgttaataggccattaacataattggctttgcctcagaagaacacatagccatatgtgggcaagatgtgctgatatttttattttaaaaatgtagatgtgtgtggtgctttgtggagtactccgtataaataaataactttcctggatgatatgggagacagggaagaagcaatagcagacatcagccttgctctcaaagtgcttgagctactccattatgtttggggatgaagtgatagaaaaatgagatgtgatctcggttctccaggagcttacccagtaaataagacaggaccatagacagtgcacaaagcagcatgagcagcgagaacaacatgcatgcagtgctctgggtggtcactcaccagtcccagcagcgagtcagggctgcgcctttcttcttgcactgctggtacctgatgcagtgttgacacaggaaaaaaaaatgaaatatttattgcttgagtaactgagaggcttttattaaagtgagaacttgatggagttggcaccaggcctggaccaatcccagaggcatttacccagcattgcacttgggtgctggcttgggctgtgtttttctcccaaactgtgatgctatgagagtcttcgctgacctgcttgggaaaggtcaccgggccatggctttagcagagattttgatgtagagagatgctggggtgactgcctcttgaaaagcaaccttgcaagctggaggggggctgttttccctgtggtggtggaagaccaagcatagcaccagcagctgttcagagacaggaaaggcagcttcattcaaaaagccatcataatttggcaaggagtgttccaatcagtagccttcctaaggcatgtaattgttatgcaaataagccacagcacattacccaggctgggaacaggagtatcaactctgtgatttacaaggggccaagccacccaagaaagctctggcatgcatcccacgctgggggctcagtggagctgtcttggtgctgggctcatagagagagctggcttattaaagttgaccagtggagtgaggctgattgtttaaaaagtgaaaatatccgagtttaataagatgatcaaggtctggattttgattttctgcctgcaaatatcagtaacagaatattacagctgaacacggttttagagatgaccacatatccaaactgcttatatttcagaggaggaaccaaggtgaagggtgaagtgacttatccaaagaacccagctccccttgcctccaagttcagggtcatttgatgtcaaacccagctgtctcttaagctagtgtagctacaacttttttttttttttttgctctaagccttttattgtctccttttttactttcttgtcttgtccaacgaattcctattgtgaaggaattatgaagatttctggacacctaaagagccttatttattttcaggagggtgcagtctgatattatagatgagacaaacacccaaggaactgcagtataagcgttaaggagggagagaaaggtagaggtgttcaaaggagagagggatcacacacatttgggataaatggaagaacttcatagagtagatgatatttaaaatgagctttaaaaatcctaacagagataaggagaggagaaagaagcaggggcttgtgggaatattagcagcaaaggcagaagaaaatggggcttgcactaggaacaagagtagccgaattggtctggagattggggaaatcttagtagagcagatgtaaaaagcttaagggcccgtattcgagccgtagaatccaggacaaggctcggcagaacattatgcattggaaagagttctgggtttagaacccaaaggcctgcttctgcatcttagtttcacaaatgtttggatatgtgacggacacaaatacgttaaacctgtaaaccttcatttttctccttacaaggtcattgtagagatcaaatatgatgaaaatgtgaaacgcctaacacagaacctggcaagtaaaaatgagtttccatttgtttcttcattctgttggtttggaaacttcagctgactcagctatcatagtttcctgtcaattcttatttggtgatgtcattgatttttacgtttaaccctttttctaaaataagctgagtctaagatcaccatgtgagccaagatggcatccatcgctgtctttttgtttccccctgtaatatctctcctctagtcattcttacgtgtaatcgtcagattaattttccttgaacacctcttcagccaatagtcaactgctaatgtttataaacgtgcggtggttcctgtgtgagctcattgtatcaaattcacattcctccctcaggccctttcccgccagtgcccgttatccctcagtgttctcccaaaacctcctctcaggctttccagtagcttccacagcctccccctccatcgacaaatcccaacagaactccgccttcaggacccagtgctgcctgcagagtgggcccctgtcaccttggactttgctctaaccaccacgtggccttatctacagaaaccacatcctaatcatctcactacatcttatctgtcttgttgctgctatggggctgaaagtgttctaaaatgattgtctttttccatttcttctgtatcctgcctggtgcctagcactgtgcaggcataagataaatgcccaatacaaccatgcactgcgtaacgacgtttggatcaatgatgaactgtgtatgtgatgtgggtcccacaagattagaataccatattttactgtgtttagataggcttagaggcagaaatacttaccattgtattacacctgcctgcagtattcagtatagtaacatgctgttgcaggtttatagcctataggtttgtgtaagtgctctctgatgtttgcacaatgacaggattgcctaatggcgcatttcttagaatgaatccctgtcattaagtgacacgggactgtatgtgctgtgaaataagtcaccgtacacctcgaaattcacagcggactttcctttttgcccacagggaaatagttaattgaagggaaacccttgggcccgttgttctagttccaaatggactttgaggctgtgccatttaccaaattatctcttgtctatgaactgagcagagatggcccggaaaccaccgagggagaatggagatggaaacgtacatccttgtttttagtgtcaattttctgactgcataacacacttaaaaattaaatttgctaaaggcacttcaagtgcattccttgctaacacttcattacaaggcacttatcagtaataaatccacagggcctatgttttttaagaaaataagaaatacttagaacaaatacagaaaccttgctttcttcccacttcctattttagttctaggggaaacaaataatttctagttgaatggattaaagatgtcagactgttgttaatatagtactttcataataacaaaatgccaaacttaaattcttctttcagagatttaatataaactggcaactaagaaagtaaggggaatattttgctgatattgtacatctacttattatccaagaaggatctctctctggctttcttttttcatagttctagctagaggttactgagacctcaggaaataccccatctactcatagagctatgctttattcagcatccatctcatcttcctttgtcccttcatcaagttggtgaatatacatttgccatccgtatttcttttatctcttattcacattttgaggcactatagtgtggcttctgctctctctactcaactaaaactaatttccttaagggcaataacctctctctaacatctagactcaagattcagcacttaacttttatcttactcagcctctttatgatatttgaccaaatggctcaatattttgcttcaacactcttcaccctttcattctgaatagtcaggcttcctcctgcctttataatccccctgccttcttctccatcagcatcccttccttctcagtctcttacaagctgctctcccagcaaattctcctggttaaaccctccctctcccagggcctcaactgttacttacgttctgaagaccaccaagtctactttcccagcttcacatttttcttgagtgttgagatgttaagcaacattttgttctagtagaaataacaataaatgcattaatttgtaaacacataaacaaaaacccagtatgctagatggcaacatgctctagaaaaatcgggctggggaggagggaagagaccgtgggagggttgtggagaggaggtctcactgagagaacactggagcaaaaacctctcggcagaggccatcctgtggatgtttggagaaagagccttttaagaatatgtggctgccacttcatatgccataggcaggagtgtgagcaggctgtctaaggaacaaggaactgtggctagaatggacttgtgggagaggaggagaggtcagacagggatgaggagccacgtcacacgaggctctgtactctgagtgaaagggggccaggggagggctcaggacagaggagtgacatgaacagacttgctttaaacagctgttcctcctgctgttgtgagaatctattgcatggcagaaagtgcggagtgatccgggtgtgagacagaggtggtttagagcaggttgaaatggatggagggagaaggcatgggattccgaatgtgttttgatggcacatctggcagtggttgttgatgggccgggtatgagatatgagagggtggaaagagtcaaggctgattccaaagtttttgttctgaataaatgaaaagaagaagttgacatttgttgcgatgtgaaacatgtgggggctgtgagttgggaacgggatgacatgaggagttggggtttgcacatgttcaattttagatgcctactaaaaattcaagtggagagggtaactgagcagatgaatattcaattctggaattcggagaaagagatgtgtatacgtgtgtgtatgtctgtgtgtgcgtgtatatacacatgtataatctacacattatacatatgcaaatgtatttgagtcattagcatagcaattatatttaaagccataagagtagatgaggtctccaagggggaacatggagacagaggaggacagagatccaaagactgacccctgttccctcaccctggatatttccttggttataaagccttgccatctgaatcctagaaatatcctttattcgtagcttctgcagagccacaccttgcagacccccggggtagccattcacatgagtggtttaaagggaacccctctgggacaaaaagacagtatgagtatcacttcttttggaatgatgctagtcctgcttccagctggatgagattcagctcctgtcattttaaggcttttcagcggagaagataccttgattggcctccctgctaccaaactcttctctccactgtgacatcagggggactatgttaaaccaaaatctgatcacaccattcctttcttaaaaacccatgtgacttctcacttcttagaggttaaaagtcaaataattttaaaggcttcccaagcttggtccaaacgattttcctaccttttatctcctacctcagcacccactggtcatcaactacttgtgtttctttgtatcacctgtgctgtgaaggtgatgtccctgtctgccactatcagacagaggtcctatttagcccgccggcatccggtatttatttctgcctccaccagtttctcaacaccattcctccattctttttgttttgttggaaacttcccaagtccacaaaccattttcagcagctcttacattttccacaggacttccgtgtctcctctggcccatttctgctcttcattctgtatccaatcctgatgttctccagggactgtgcagatcttatctctccaatgagatcataaactccttctgggcaaaaaaagtaaataaaaaaataaaaccacacattttttgtcctattctccatagcattaagcagtgtagagccattttaataaatactttttggaattgaattaaatacattgaacctgctccctactttagcaagtttgtagatcaggtgggtcaccgaagactcctatatgcactctatataattctgtctgccagctgtggctgggtacagtaactcccagggctcccaaatatctcttctttatacaattcaaggaccagatgacaggggttctgccaaagtgtatttataagaatatgaaaaaaatatggccacatgagccacatgagtgaatgcgtggctgcatttacagtgagtgtgatacacattttcttgtgattttgtgactgcgatatgagtagatagctatctatgagctaaatctagagggaagctggcccagttccagattctgggtattttgggatattatttagttgttattgacacagttgagaatcagctgagagatccagcagagagagagaggtagaccttccttaggagcccagggcaggggaacaaagcagctgtgaatagcttagcaatcagggcctcctattttgaataagtgttttcaacaagcaaaaaaacaaagctcttcataaacaaaaatatctaatatccattgaacctgacaaatgacaaaacactttcacatgtattattttatgagacataccaactaccttgcaaatagacattgaaaagagatgatgatcccacttctataaatgagagaattaagctctcagatgtggagaaagtaacccagtgtcgtgcaggcagggagcagaggaaagtatgtgggacaagggtcttcacagtcaacatctagtgctttctgctatgcgttaacattgtccccaagacaatgaaaatttcaaaaagctccctatggcttcatctaaattttctgccccttctctaatctcttttgaaataaggaattccgtggagacactatcactcattcacatatttggcagccaaataagaacactgttttctttttccttgaattttaaaaggtaatttaataaataaatgaaaaacaaaccgagaagagtagctgaactagggcttatgtttctaataaaattataaatgccagaaagtactaggagtgatttattatcctgttattataagtgactgggaagctttcaatggagtccttgctaatttctagcagctgcattaaatcagaaactctattagctattataaaatcatcatcccatttttctgcaaatcaacttgaacacctgatgggagcttggaactggttgcggctatacatgctaacctcatccttggcctccacaagggaaataaacacgagtcacaggtggcatgatactggtcacatcaactgttagagattcataaatggctgcctgttttttataggagatctttctgatgcgaaaacaaatagcttctttcagcaaataccacttcattaagagaacaggaactgagatagcatcaagtcctgtgttctgaattttaacccctccccccacctcattcgatccagctttccaccctggtccagcagctgtccacccttcgtaagaacagaacaaataactaactacagacaaatcttctggaaattgctggcatttctaccctttattctgattttcacaataaaatacacctccaacgatccactctatcatgaccagataagtaacaccttatgttggacaaggaagaagagtcaaaagcagatatcagtaaatctttgaaacgagctttagtcttatgtttcaagagatagctaggccgaggtgggcggatcacaaggtcaggagatcgagaccatcctggctaacatggtgaaaccccgtctctactaaaaatacaaaaaattagccgggcatggtggcgggcacctgtagtcccagctacttgggaggctgaggcaggagaatggtgtgaacccgggaggtggaggttgcagtgagccaagatcacaccactgcactccagcctgggagacagagcgagactccatctcaaaacaaaaaagaagacaggagaaggtactatctagaagatatgcctactatgtggacagatcttggcataggggatgcagagtgcaaaaaagaaagccagctgctgatgataggaaatgactaagtaggaagaataaagtagaatttccagaaaaatagattttacaggacttagtaagaggttggatgtgaaaagtgtgcttgttttttttttttttttttttttttttttttttttttttttttttttttttttttgcttgaaacctggatgggacatccaggctggagaagttgggtaaattaagggaatctgaaaagttattttttatgctgagtttatgcacccatatactcatattatatgcttcttcctcattgcctttctacttgctattttctctgcctggcattttttcctccaaaactttgcatggttcatttgatgaaatgtcacttcatcagagaggacttccatagccatacaactgaaaacaaaacttccatcatttgttattcttttatctgctttatttttcttcaggatacttaccacttcctatcattacattatatttgttatattttctttctttcttatttattatcctactgcaatcttaagtttcatgtcaatatagacttggtctatattgttcacatctgtataatcagcacctatagtggcatcaaggtaggtgcgcagtaactgtggagagaaagaatgaatgagttccagaaaagatactaaaatagcaggtggatatatatgtacagagctccagacttaagagactgattagtgaattattagcttataggtaataattgaagctatagactctggagaaagtatagagtaaacagacgagagggccttaaacagagccttgaagaaccccaacattcagaatccaagcagaagaaggtaatcttgcaatgaaaacaaagagaaaacaggcttagggctaggagaaaatcaaaggacaatagtgtttgaaggaagagaaagtgttgaaggatacagagaagtctcgagaagttgaaggtttaagaatacccattggatagtgctgcaataaacatacatgtgcatgtgcctttatggtagaatgatttataatcctggtgtatacccaataatgggatttctgggtcaagtggtatttctggttctagatccttgaggaactgccacactgtcttccacaatggttgaactaatttacactcccaccaacagtgtaaaagcgttcctatttttccacatcctctccagcatctgttgtttcctgactttttaatgatcgccattctaactggcatgagatggtatctcattgtggttttgatttgcatttctctgatgaccagtgatgatgagctttttcggtgaccataggaagaactttggtagagtggcgagttaaaggctgtattggtatgcaaagtgtgatggggagatgagaaatggaagcgaacattttggaaaactctttgagatacttggctgaagtgaggaggaaactaatagagaggtagctggaagatgaaggaccaagttaaaaagttaatttagtttatgttgtcatatatttcaaatagaaagggtaaacttgatatagtgaggctgaaatataataaaggcaagaaatgcttattagagtaattttcctgagacatcaagatgggataaaacccaaagcatggccagagacatgagtgattatgcgaggagggacagcttctccatagcagctggagggaaagaagacccacgtgtagataggtctgtgtgcttggtaaggggcaggctagaccagatccactccgtgctttctctatgcttggtaaggggtaggctaggccagatccactccgtgctttctctatgcttggtaaggggtaggctaggccagatccactccgtgctttctttattgctcttaagtagaagatgatcatctgccgagagcaaaggggagatgagtggggactcaggggaatgagaagattggagaaggtttggaaaagtcattgtggaaagtagatgtatgaagtgaccaaagattagctggaaaattgtagaataaggctgaagggtctttgcctttggtgagcatgagtttattaagtaatcagtcaactttgttgtgtccttaactgtgcttgacttctcagctgtagactcagagaaaacagaaagctgagttcacccaggcttggaatttgatgacaagtttgtgacaaaaagattattgagcaaagaagtctaaggtgttggagcaattataataacaaaccatgaaatccaagctggtttagaaggaaactgaagaaagtagaaaccttttgaattgagttaaagtacaggagtcaatggccaggaagttgcaaaatggtcaaagatgcatcatggtgggaataattggagaagcaagctgacgaaagagggattgtggtataagcatgggatgtctgaataagtgattttggaggtggaagggaacaattatattttgtgacaatacccacttgcacagagcctcatcataagctccataaaatcccttagaaggaggagaaggaggacatttgtcttaaaatctaggccaggatggagccagaaattgaggatgaagagacctcattgatgaggagaaaaaggttgtcaagtcagggtctggcactagcacaaaagttgattaaaaacaaacaaacaacacaaaactgtcatacttgctgacactctttggtgcagggagatagctggaggctcagtaccaggtatgggctgtgtgaggctcttctcagacctgtgtacactcaggcttcctaacatggagttccaggtgccagacagacctaggtggtgcttttttccatcaacaacattatgaaccaacagcaatcaacttctggtctgtggaatgagtacagccagcctctcagggcctcaagcagagggagcagggggctgcggtttcccatgaagatcacagaactcactgagaacaaggaagggcctgttcccagttctgtttttgttcagcagcaaacagagccacttgtcaggctgacggtccttgcgcattgctactgtggcaatagtctgaaagagggtagagggaaatggaggaaagagacattaaaaggaaaatgtcaccatttccaaatgccatattatttgacagtttctctttatgttgcaacagctgcttaacatgacaaacgatggctttaataaaaacgcacacgaagagatgcagcaccagaaaatgaataatggggctttccatcctgacatgttgtggagcatattcactcagcaatgaatatgaccttggtaactgtgtgttgcctgttgctttcagacaacccctgccaggtggatggccctcatgccagtcaggttgcagttgctgtaagcccagaatacaccgcaacttgttttagcagagaggtgtttagtgtgggacattaaatggcttgcccagtcatcaagagggtagacaaaacaggttgaatttttagaaaatcacaccgcaggactggggccaccaagacttcctgttttacaacgaagaagctgccatctctcccagtcagagccacccaaaatcaggaagacattattatcaggaaactgcagcctctgggaagctgcctggaccaggaagccactctatgtctgcctgtgtgaccagcaccaacaagaatgccccatccctgtctctgagtacctgggatggcaagtatttaggcccttggattcctgttaatggttctgctgtaaaagcaaatgactccacattgatgcttgccaagaggataacggcagcagcagtagcagcagggtggttaatgtacaagtaattgaagtacaataagttacatacaaggtgtcaggctagattggggccagtagggtctagtggttttagggcccacatatctagatttgggagtagataataaagccagtattggtgtggtttggaggcgggagggaaagagagtaaagaagagggtgggaaaggtgacagtgtaatgaccaaacagcctgccctcagccccaggactgcagacagagcctccctggaattttgataatcatgtgtcttcacacttcacttactgtcttgtcacctctgtacagctgcataaggagaagaaagctctttgccattgaaagttttacaaagaggccattccaagtcactgatcagagctagatgtatcaagtcaagaaaagctatagtgcaaagcacatcaatgctggagaagaatcaagaatggggtggggctgaacgcacgggcttagctggaatgatataaagaaaggctgtgtttgcagggagcttgaagactcgcgcatgtccctgataaagtcatgaaaatctgttgttcattttagcatgttagaaacatgctcattacttagtggaaagcaaaaatcaatagaagaaaagtggcacagcaaactgtatgaaagccattgggaaattttagtcaatatttactgatcacctactatgtgcaagctattataaagaacaaaataatattttgtctgtgtagtcaaggaattaaggccttcatcaatcttgtcagagccctcagctagaggaattttgaaagatgttgtttttcagcttgccttctttctcaacagctagaaaaaaggcttctttgtgacagtcggtcactgtgtatgaaaaggttaaagtccttttagtactgtgctataagggattgagagagaaatgaagactctgccactgtagccaaggagatgatggtctacctgaggagctagaacaccaggaaaacaatgcacagtttaattggcaagaacctaatagaatagagaacataaggtagggaatttctaattgccaaagaaaagatcaatgaagtaaattctatagtaactaagagaaatttaagataacttcagctatgagtactacaggaggcttttctagaggaaggtaagatttaagctgtttagaagaaaagacagaactggccctgacagaaaggaaaagtaagattatcatgagtaggagaagcaacataggccaaaatgtatatatggagacagtgagttacatttgactgaaatgagggtttatgtgacatttatggaaaaatgactttattaaaaataaatttttcatagctggaaaaaaagtaaagttttattataaagatccatgaatgccacaataaataattttaaatatactctgtaggcactgataatactgagattccaaaggagatcagcctggtatgtgcaaaatcaagtaaatatgattctggagttctcaaaaactgttataataggttgatcttcttttaaattaaggaaaagctggggtttttttgtcctaatatttctctcctttgcatttttatttgtatgattctccatattcaaacacacccttcccaaaagggtaattagacttgaggtaaaacttctctgagtataaataaaatatttcgtatgtgcctatataattctttgaggattttcaaacagtaaaatgaatttaaaagtgaaaaacatgtattttgaaaacacataatgaagcatgtgaaagaggaggggcctcgatgcacttggctcctctaaggtagaaggtgagggggcaccatgacctggaaaccatgaagagggagatggatgagtcactaaacaaacaagcaaacaagagagccaggagggtcagtgtccggagttgctgaaatgtgttatataaaatattcagatttcaacaaaaaattatgagacacgaaaagaatcaggaaagtgtgacttttcagaagaaaaaaatacagcaacagaaactgcctgtgagaggccacagatgtcagatttaacaaagacttcaaacagacataataaatatatttaaaaaactaaagggaataatgcttaatgaaataatgtaaaggtatcatgacaatgctttatcaattagagaatattgataagacgtaattgagccccaaaagaagcaaatggtaaattctgtatttgaaaaatataacctaagtttaaaaaaattatgagaggggctcagtaataaacttcaactagcaaaagaatcaatgaacttaaatatgtattgatggaaagtacgcaatcagaaaaacagagaaaaaagtgtgaagaaaagtgaacagagccacaagggcatatggaacaccactaagtacaacaatttaaacacagttgcagggggggtcccagaacaagaggagagaaagaagaaatatttaaagttgagaatttcaaaaacttgatagaaaaattgacctacacatctaataaacttaacaaactccaagcaggataaatgtgaaaacatccacacccataagcatcatagggaaaaggttgaaagacaaaaacaaagaaaatgttggaagcagcaagagaaaactaacttatcacatacaaggactctccaacaatattaacagaggacatttcgttagaaacaatggtggagactataaggcagtagaatgacatatttaaaatggtatttttaaaagagtcaatcaaaaatagtttaccaagcaaaactaacgttaaaaaatgaaggtaatgcaatggcataagaatgacacaatggactttggagactcagggggaagggtgggaggggggtgaggggtaaaagactaccaatttggttgagtgtatagcgctctggtgatggtaaccagataccacctgtttccaaaaacctatggaaataaagaataaaataaaaccaggaatttaaaaaaatgaaggtgaaaactagaagcttttccactaagatgagaaacaaggcaaggatgtcctctctcaccactccttttaaacattgtactagaagtccaagacaagaaaagggaagaaaagcatattaatagggaaggaggaagtaaatctgtttgctgatgacatgatagtccatatgctgatgacacgatagtccatatacaaaatctgaaagaatcaacaacaacaaaaaaattcctggaactaataagcaatcatagcaagattgcaagataaaagattaatgatatgcttaaaatatttgtcctctcccaaactcatgctgaaatgtaatcgccaatgtggcaggattgagaggtggggactttaagaggtgattgggttatgatggctctgctctcatgaatagactaattcattcatggcttcatggattaatgggttatcataggggtggtactggtagctttataacaagaggaagaaaaaagacaaaaaaaagatttgaagctgagaatttcaaggaggaagagagatccaagcgagcatgctcaggcccctttccattggatgccctgccatacctcaggactccacagaggccccaccagcaagaaggctctcactaagtgtagctcttaaccttggactttccagcctccagaactgtaagaaatgttttgtttctaaaaataaattatccagttttaaatatttcattatagcaacagaaaaacagactaagagagtaaacatgctaaatttaaccactctcccatataccagtaatgagcaagtggagtttgaaattaaaagcacaatattatttacatcagcacccaccaaaataaaatacttaactagaaacctaacaaaatatgtacaagataaatgtgtcgatatatatttgtcaaatccacggaatgtacaacaccaaaggtgaaccctaatgaaaattacaaactgtaggtgacaataatgtatcagtataggttcagcaattgtaacagatgagggaagctcttcatatgtgccttcgtttcaagtttgttgtgaacctaaacatgctctgaagacattaattccttaatttaaaaaaaatgaaggtgaaataaagacatttctaggtaaacaaaaactgtgagaaaccttgcttgcagaccaccttacaagaaatactgcagcatagtcttgaggctgaaagaaagggactctagagagtaatttaaattgatacaaaaaagcaaatattactgataaaagtaattatgcgattataaaaggcagtataaatgcctattccttctttcttaattgatttaagaaaacaattgtagaaagcaatgtgtacataattgtattgttgtgcttataatatatagaaatgtaatttatctgacaataacaacagtaaaagtggtgggtgggtgccaacttttattagagtaatgaaataacaccagatggtaacttgattccacagggtcaaataaagaaaacaagaaatggcaaataagatggttaataccatcaactctataaatagatacttgttttcctttcttttctcagcttctgtaaaagtcatataattaattaaatagtagcttataaaaatgcactattggtttgtaacaatacagttgtaatatgtataagaaacaaaatgtgggaaaagggcataaagctatatagaaataatatttctatgtctcactggcattaagtaagtataaatctgaagtagattctgataagttaagacatatacagtaagtcctagagcaatcactaataaaatatctcaataaaatagagtgaaaaagtattaatattaaagagattaaaatgttgcatataatatgaagaaagcagcaaacgacaaacagaggaacaaaaaaggcatgtgacacgtagtaaacaaaaaagtaaatctaagtacatcactagtaacattaaatgtgactagattaaacaatcaaaaggcagagattgttagacttgataaaaatgataaaatccaactacatactatctatgggagacatgttagatacaaataggttgaactttaaaaaataaaaatatatattccatgcaaacaggaattaaaaagctggagtggctatttcacaaaatatattttaaaacaacaaaatttactgcagattgaaggacattttactatgataaaagggtcaatccatcaggaatatacaaaaattataaacataagtacaacaaatcacagagccccaaaatataccaagcaaatattgatttaaaagaagagggaaataaccaattcaacaataataattgaggattttagtacttcattcttaataatatatatgaaactaggcagatgatacagggaaatagaagataagaacaccattatgaaccaactataaccaaaagacatctatgaagcactccattcaaccacagcagaatatacattattttcaagtacatatggagcattctccagaatacagcagatgcttggccataaaacaggaattcataaactttaaatgattgaaataatggaaagtatggtatatgacttgatcaaaatcatacagtgtagtatctgactatactaaacctaaaatagaaataaataacaaaaaattgagaaatttaaaaaaatggaaattaacacactcaaataccaatgatcaaagaaaaacaatcacaagggtaattagaaaatattttgaaacgtatgaaactaaagacacaacatagcgaaacatacaaaacacagttaaagcattgcttaaagatacatttttaggtgcaaacacctatatttaaaaagagaaaaattttcaaatcaataatctaactttccacctcaaaaaatgggaaaaaaatagaaaactaaagctaaaggagaaaaagaaaataataaagataggtggaaattaataaataataaaaatagtaaagaaaataaatgaaactacaaattgattctttgaaaatatcaacaaaattgacaaacctttggctagtctgaacatgaaaagaaagaaaagatgcaaattactaaaattagaaataaaagaagggacattattaatgaccttacagaaataagaataataataaaacactatcaacagttgtgtgctggctaggctcaatggctcatgcctgtaatcccagcactttgggaggccaaggcagatccatcacaaggttcagaggtggagaccatcctggccaacatagtgaaaccccctctctactaaaaagacaaaaattagctgggcgtggtggcccttgcatggagtcctagctactcaggaggctgaggcaggagaatcgcttgaactcaggaggcagaaattgcagtgagccaagatcacaccactgcactccagcctggcaagagagcgagactgtctcaaaaagaaaacaaacaaacaaaaaacaacaaacaacaacaacaacgacaaaaatatgtgccaataaattagataacttagatgaaatagctaaattcccagaaattcacaactactaacattgactctagaggaaatagaaactgtaaataggcaagaggtttaattagtaatttaaacatctccccccgacacaaaacagcctaagaccaaatggcttcactggtgatttctatcaaacatttgaagaagaattaacactaatttttacaagctcttttccacctcctccccccaaaaaagagagagagagagaaatggaagaagtgggaacacttcggtacttatttccagatgaggaagatgaggctggcgaggacgaataaacttccctaggttgcacagcttacaagcgatagggtgaagatctgaactctgcttatctaattattttcctactctgtgtcacccatgtagtgagagatacagaaaagtgtagaaaatggttactatctccaaagacacaaactgtctaattagacacataagaataacatctctgaggaaacaagatgcaaaatacagtgtgttgcaatataaggaatgcagagatttgaagtaaatgacctaggtctgaatccaccagtctctgcttgatggctctgggcaactcacataaactttctgagcctcagttttcccattttcaaaattggcgtataacagcttcctctctggccttcataaaggaacgatagaatctacatagcaggtagtagtattacccactattccatgtcaaaatgtgtcatccacatgtgcctgctgaggggatcagaggaccctggtgccaactgtaaggtcacggaggagtggacgtttggcagagccttgcatggtagcgactgggcaggaggaagcggtaggatgtaacagggaggactggtgagcaggtttgtaggttgagaaggaacaaatggctttcttaacaaacgtttctagacattttatgtactctctcatgcaatcacttcctagccaagtagggctgttatcatcctcatttttcaggtgagaaaactaaggctcacacaggttatggcatatgtcttcagttcttatagttactcaggggtggaatcaggatttgaacccacatctgaaggattgatcgcaaagtccaaactcttaccataatgtcatgctaacatctgttacataacaacatctgctgtgaaaagcagtatcatgaagactgcacaccaggcttgtaactggagattctctcttctgcttcaaataatattcccatgtgtttttgtagtcaacacgattcagacactgcactgaaacgattcttctcttttacttatatatccttcttctctcatttcctttgtcattccctctgcaccttcaggtgtttcctggactgtgactttcctctcaacagcaccattaggtgtgtcttgccctctgggttcagcacagaaggatttctctgccagcctccagaggcttccctcctgcacacaatggctgcttgcagagtgggcacaagcctgacctgccgtatacattcactcacctgaactgatatcgaatgaggaagtgagtaaattcaattccaagtgtgtaactacagaagggttcaagatgcagctggtggccctgaaatcttaggtgcccgaccctaacgtgcagctaggatataggtagaatgaggacagagacaatgttcgaatgtagaataataataaaaaaaagtaagaccagcaacaattaataataataataataatatcgtaatacggataggaagaagagctaatatttgctgacaacctagaccctggcattctctgctccctcacttttctcttcctctatataagaatggtgaaggaagtggaagcaggaaggacattctcaccgcaagagccacagtttttttttttttttttgagacccagtcttgctctgtcactaggctggagtgcagtggcacgatcttggctcactgcaacctccgcctcctgggttcaagcgattctcctgcctcagcctcctgagtagctgggattacaggagtgctccaccacacctggctaattttttgtattttttagtcgagacggggtttcaccatattggccaggctggtcttagactcctgacctcgtgatccgcccacctcgaactcccaaagtgctgggattacaggcgtgagccaccgtgcccagcccacctgtcagtatttgaagacaatttgtggtgtagtgattgttgtgttcaaggaaatcttcaagcagaacctgagggccatgagttgggaattgcacatgggagatgttagcgttaacacacattacaaaaatgatatcggaggccctttccaggtcctaaagtctatgacacggtgattttcaagtaacctgaagcccaccctgcaagcatctggggttctagtggtggggtggataatgacatgccagtttcccgtgttggagcccaggggtggtcacgtcaggcttcacggctgcaggtccccattcagagattcctctatgcgtgtcaagcaggcctcctgctctgtctggcagagaaaacagtctctgttttgtcttcttatctactgggggaaggcaggctggtggggatgaagtgcttctgaggttggagatgctgaagcaaaaagctaagttggagagctcctggtgtaaagtaaatattgtacgaaaaacagcaaagactgaaaacccaaatgcggtgaagtgcctgcccgtgaatggatcaaaatagtgcctcccacaacctttgtcacagccttctttcccagaggagggctccaaggtggggatggtacagagtagagccaaggctggggtcggtgggaaacatggttttaaacacagacttgtccattcggggagtgtgtttgaagaaataaatgacatgtctttaactgggtgccccctctgtgacaaatatgagaataatagcagggttttcctttggtccacaatttctgttctctcacgcgacagtctagacttaaaaatcttttcctcaagctctgagtagaaatcactgactaggcaaactgatgatgcacaggcaaaattagtctgtttaccatgtgggagcttgctaattgcaaacgaatgtgagttcccaggcacactcttggtctgcagatgctgtcttcatcatgatgggggagggtgagcaggcagagagagcccgggccgggattggctgagataattgggctggtttctgtgctgtgctttccccttgctcagttttcttcctgagatgattcatcaagaagcctccttggccctctgttgtacagtgttacaagcatccagttaaaacaaacgccaggatgaaaatggacctcctacggaaaagtgtcacactcattcatttagcaaacatgcactgagcacggcctctttgccaagcattgtgcttggtactgagaataaagaaagacctcagtgcagtagcaaagagaaagtgtcctggactcaactaggtcaaatgtattgtaacaagattacagtacggaggatagaattctgagggcatccagaagacagagggagtgcttttgcagaggaaactggaagactgcccagggaaggtaatttctgagcctgaccttagaggcaagacttgtaatttggctggcagaggaagacctttcatatggcagaagcaacaggagctaatgcagagagagatggaaatgtcaatattttcctagaaaggccagtggtccagcaatggccagggatctgtaggctattaacatctgaaagaggctttgcaaatcatcagtcaaaggggctcatcgtacagatgaggaaaccaaaggccacagagctgacctaacttctgcaaagtctgaaaccatgattttttcagttgcttagcccggccctgtgggcctatttatatttaccattcttcacacatatttaggtaatagaattacatctcacatcagtgtgctcggcactgacttttcttctccttgctacatctacgaatagcatcgcttgactcttccaccttaaatgtgtccatcatcctccccatcattgaagctatctatcaaatatggaaccagaacggccatgtcagacactctatacactatttgtttatatcttgggctctttagagctacatatatctttgtgctgcttatccttaaaatgtacttttttttaaaatttaagacgtagaaatcttagaatccattcttctacggcatcaatgtgcttagaaacatcgtgtttcaaagctgaaaagacactgggatgcagctcagctcagggtgctgctcacatgtctgtgtcagtgtctatatctccaggaaaactatttttgggactccctgcccagcactatttattagttttccgttaattacgatgaggatgccgagggttatttctgacagacccttgctacttgaagaagaaagtcactcatgccctttttcggaatccggcagctttgctctagatggaggctgctagattcagcaggaaggggcagggtgttgttcatcgccgcacctgctgcttctcccctcagccccgctgtgtcctcagcatcactgcagcctcaccccagttacaaggttgtccagctgcagacccagtctccagtattctcttcggggccccagtaacatgggttgattgcatacacaaagatgtcagaccaaatcaccacgtctgggaattgtcggtaaaacagtgtgtggaatgaaatgcgcacattgccaaagggtgggggagattcgaaagcaggatatcttgacagagagagaaaagtgttggaattaattcataaacgtgtcggatggaaattagcagctgaagatttgcaaagggagaagagacagagggagagagaaaagggaagacagacagatggagagggggagggagatggtggaaaatagagcagaagaggcagctttatttcgcagccctgctttactctccactgaagcagcctgtgcttttgcagggatcctgccttgcctccggtttctgttcccctgttgacctccaccatccgcagtccccgctcctggcctcgccccaacctcctgcttccaccacaacagttgtgctttttacacacgtgggattcccagtttgttcagaacgggattctctctgtactaagcacagcaaacttcccatgtgaccgtggtaagaagggaaggactggggctttcgagggacatcttgactcttgatattctaatcttatcttgggcctcagttttctacacgtaaagttacggttattgggccggctaaatgagattatgcacgtaagtcacttaccttagaactggatatgctgcgtgcacgcagtacattgtttactattgttattaacggtggcagtagtaggagtagtaaattttaaattctgtctctggtgttttaaacctcctagttcaatctttgtggtcaaggtcaagaggttcaagcagcctgtttaagctcaattttagagccaaacatgtttcccagattccgtttcttaatggaaggttggagttttgccccgtaacagtgagtgttttggacggtgttccattttggaacataatacaggcaatcacccagtttcattttgaaagaacaattgagattactatgtgtgagatgagacagatttgggttgttttcctcctcaggctgctatgttagcagggtgtgtcctgaagtattctctctttccaatttcctttctgccttccagatttaaggtgccacttctaaatctgagcctgtgtatagtagtattgtattgtgtgtagatcctgatattttcccgaagtcaatgtaggtaaatggaaacgctgtgaaccactaggatgcttacagagctatttttggcctctctgcattccactttcttttccactctctgtgccatctaatcccttgcactgtgccccactcttcccttcccgaaagattgctctgtagcaagcgatgctgtttgatagcattttacccacagtagaacttctttcataattggagacagtcctctcaaatcccgccgctgctttatcagctaagttcatgggatattctgactcccttgttgtcatttcaacaatgttcacagcatcttcaccgagggtagtttccatctcaagaaaccacttcctttgctcatccaagagaagcagctcctcatccattcaagtttattgtgagactgtcacatctttagtctccacttgtagttctagttctcttgctatttccaccacatctgcagttacttcctccactgaaatcttgaacccctcaaagtcatccatgaggcttggaatcaacgtcttctaagctcctgttaatgtggatactttgacctccttccatgaatcacaagtgttcttaatggcatttagcatggtgaatcttttccagaaggtttttggtttactttggccagatccatcagaagaatcactatttatggcagccatagccttacaaatgtatctcttgaataataaaatttgaaagttgaaatttgtttttgattcatgggctacggaacggaggttgtgttagcaggcatgaaaacaacattcatctctctgtatatcttcattggagcttttgggtaactaggtgaattgtcaatgggcagtgatatttggaaaggtatctttttttcctgagaagtaggtcttaatagtgagcttaaaatattcagtaaaccctgctgtaaacagttatgctgtcatccaggctctgttgttccatttatggagcacaggaagagtagatttggcatgattcttaagggccctaggattttcagaatgataaatgagtattggttttcacttaaagtcaacagctgtattagctcctaaccggagagtcagcctgtccttaagctttgaagccagacattgacttcccctctgtagctatgaaagtcccagatggcaccttcttccaacacagggttgcttcagctacactgaagatctgctgttgagtgtagccaccttcatcaatgatcttagctaaatcttctggattacttgctgcagcttctacataagcacctgctgcttcatcttgtacttctatgttataaaaatggtttctttccttaaacctcatcaactaacctctgctagcttcaaacatttcttctgcagcttccttacctgtctcagccttcatagaattgaagagagttacaacctcgctctggattaggctttggcttaatagaatgttgtggctggtttgactttctatcaagaccaccaaaaccttctctgtgtcagcaacaagactgttttgctttcttatcatttgtgtgttcactggagtggcacttttaatttccttcaggaattttcctttgcattcctaacttgactaactctttggtgcaagagatttagttttcagcctatcttggctttcaacctgtcttcttcattaagcttaatcatttccagagttttatttgaagcgaggaatgtgcaactcttcctttcatttgaacacttagaggcctttgtagggttattaattggcctaatttaaatatttttgtgtctcagggaacagggaggcctgaggagaaggagagagactggagaatggttggttggtagagcagtcagaacacacacatttatcgattaagtttcctgtcttacatgagcatagctcgtgctgccccaaaacaattaaaatagtaacatcaaagattactgatcactactagatataatgagaaagtttgaaatattgcaatagttaccaaaatgtggcacagagacagagtgagtacatgttgctggaaaaaatggtgccgatagacttgcttgatgcagggttgccacaaaccttcaatttgtaaaatacccagtatctgcaaaacacaatgaagcaaagcacaataaaacaaggtgtgcctgtacacacaatatatatgtatgtgtgtttgtttatttataaataaatatatatttaagtatatacatttatttatctctacctctgtcttgggatccatctctgtaaaatctccccttggttgtgtttccctggagaactctgattatgtgagacagtcagaccccatcctgcttctctcccgtgttatgcccctgcccctttctttccttttcttttgcttcctctttgccattttcttcacacccattttctggagactttctaatgcctggaggtggaaggaaggaggatgagcaatggattctccgtctccttccttcccagtcttctgaactgcatttcctgccatcatgggaaattttgagcctcatgacccagagggactgttttgttttggttttggttttggtttgagacaaggtcttgctttgttgcccagactggaatacagtggcatgatcatagctcactgcagcctcaaactcctggactcaagtgatcctcccacctcagcctgttaagtatcttggactagaggcatgaggcagcacatctgcctgttttttaaaattttcgtagagataggatcttgctatgttgcccaggctggccttgaactcttggcttcaagcaaccctcccaccttggcctcccaaagtgctgggattatagctgtgagccaccatgcctggccttgttttatttttccctgactctatctttgtaaaactgattccatccagccaagacaggaaactagagttgctgggaggagaagaaagcttttagggtcgaatacagaatacaatgtcagtgctgggttaaggagtgggtatggggcattagtggacgaaaagaggctagtcagagacagatccaagatactgttgtctaacataagtgtggtggtggtgaggatgcatacagcccagcagaattttagaaactgtccaatccaatttggtcaaaacccaatttattgtgggtttctaccaaaatgtttgaggttttggtcaaaacctacaataaaaatgctgtgtcaagcatgcccagaacacaagagcatatgagagaccctgagagtgtgtctgtgaataaaggcggggcactatcatgtaaacatacgttatgagaagcttgctctctaagctgagttacaatatatcacaataattatgtaaatcacaagcaatgtttctgatgaatctggctctgttttattgattagaatcctaatacctgaagctgatcttcattgcttgttagccacgtggtacggctacctgcttttccaccgtgattaacttcttgccatgtaaatagtgtgttccaacatcagtagtgtatgggcacaaaacaaactgaatcactctaattcttgttctccacctttagctaatttgccactgataaaatccagtgtccaaatgtggacaaatatctttgattatttaatatttggcacatgaatcttgaatagctatgatatctgtgagactggagggtatgggttagagatacataattatttttattattaattgaataaatattgattggaaacctactatatgccaggaattattctgggtgctggtaatacagcaatgaatgttgagggaaataggaaaaggttcagcattttctttgttttgtttttgagatggtgtcttgctctgtcatccaggctggagtgcaatggtgcgatctcggctcactgcaacctctgcctccccgggttcaagcgattctcctgccttggcctcctgagcagctgggattacaggcacacaccaccattccctgctaatttttgtatttttagttgaggtggggtttcaccatgttggtcaggatggtctcgaactcctgacctcatgatccgcctgcctcaacctcccaaagtgctgggattacaggcatgagccaccgcgcccagccagattcagcattttctaccttgcacttctagaaatgactaggagtaatctttcttctctatatattgctttatcaaataataccttccttatagaggtgttaacaggattacattagatagcatctgtcaggtgtatgttctagtgtctgggctgctggtaggatgatgatgatgatgacaatgacaactgtcactattttttaaatattggttggttggtctgcatctgaatgggtccagagagggaagtgttttgacctgaaacaattcatcctgtatatgtttattaatcatcaacagtgtacgaaatgctgtgatgaacacaggcagctgtacaacaccttgaaggagctcttcaccttcagacacattaaaaaaatattcaggactctcatgctgaagatgaaataagacaaaaccgtgccaacctcccccagatccccatctccgtccagcatgttttcacagctaagctcgacaccctggaccgcatttgttttctccacacctggggttccactcattcctcagctcaccactgcctcacttctgctgcctcagcagcaaaacaccttctgcaaaattcatcagtgccctccactgtggcagatcaaaagcatggttgtccatcctctgctagcctgaagtctctcgtagtggatgccgctagccactcttttcttcttaaaggtctcctccctgatttctgtgtgggcaccgatcctgagtttccttctatttttttggccattcctcaggcttcctcatgagccctttttcatcttaccccatgtgtttgcgttgctcagaattcacacttaatgccacatttcttctcactcctgctcttgctcagtgacttcattagtacccagggcttcagctcccatgtatgcaaagatgattccaaaatctatgactgtaaacattgtctcttgctcaggctcaacaccgaaatatccaaatgccaacagcgtagttttacttggatgtttcaccagcccctcaagttcaatgtttaacgccctgccctctactcagtatcaactattcttactatgtctctgggactggcaacgctgttcactcatctgccaaaatcagaagccacatggcagtcagtcatacccagtccttaaaagtgaacttttcctttgagtctttaaaaaagttcacttaaaagtgaacttttcctttgaggggtcttttcctttgagcagctttccaagaacccgatctaattttaatggcctcattttgagatcctgtagcatgctgtacatatttttaatcttctcataccatactatgacacctgatttatttcttctactagactataaactccttgagggcaggtaacacaccatgttctttggatttccaggccaagcaaaatgcctagatggtcaatgaacattggtcctcccaccaaaacaaacaaaaaacaaaacaaacaaaaaaacaaacaaaaaacccaagaaagaatgtttgaatgaagtagtgaattagttaacaaaataaatgaacaatataaaaaaagtttggcaagagagatatgatttcaagtaactgacatgttatacaaaacacaagttctagctcctctctaagacccagaaaatcagattcattttagcaggaagtgggtacagccccgtaaggagcagccagtcatggagtaccacctatatgccaagctctctgcaagccaccttacatacattttgctcgttctttaaataaaaaaatgttgtttttcccatgcaaccaaggaggaatcctgggctcagagaagcttggtccattgctggggacccccagctctcagggggcaggtccagatttagagcctggcaaacctacctccagcggcattctctcctccacactctgggttctctggggaggaaggatccattttccacctgtcatggtcattctgttagatactatagtgagaccagggaggggtaagactgtaataatggtactgaacatttaaaaaacacattttatggcttgtaggtctcaatataatggtttttgttattggatttatagaactatatgaggtgtgactataaagcaatgaggctgattttatcgtatggcttgcggaaatcggtccctttataggggtctccagcctttctagaatgaaatgctttaatgtagttgatgcccatgcttccccacagttgaggctttggggtccagggagggaaggagaaggatactaagagagttccttagtgggaatggcattggatctttggctgacagcttcacggagtttctgcagactgtggagagtggacatcagttctctcgtgcagcaaatatttggtgagtacttactctgtactgggccctggtctgtagcagaggaatcagggatgagcaaaataaaaactctgttctcggggaccttgcaattctaatgagagacagagaagttacatgcatgcaatacacacagaaacttggaaggaaaaagagtaggctaggggctgatgttatactccttagattctaaagttctcaatagatcactctctaagccttggggaacctcatagataactttttacagtgtaaatcttacatgccttaggttggcttgtttattttaaagtttttttgttgtcatgttacttttgtttgtcttcttggttatttttgttgttttgtttgctttggttttgcctacttcatcattctggcattaaggatggaaaaaaggaattgactatcccccatcatggagagctgccatcgtgccaggctctgggaagggcactttcccatgcatcaccgcgctcacagccatcctgtgaggaagctctcatgcacgccgctcacagaggagggtacacaaactcagaggatcgccctgcttggaagtagcagagctgggattggaagccaggcattttaattcacgcacaatgttggttccttccatcagtccaggcagatgcattctaggttgaaaaggatgtgatgtggtctgtgatagaaaagagaagcaggttgggatttaagggtcctgaattctgcccttaggttagcagctgactaggaaaaccaatgaatgtgtatttgcataagttttggaagtgtgcaaacaagaatgagaagcgaggttccacatggatttcctgcattaattgtgcaagcagctatcatatagggattggtttgggttttttagaggacagtacttgtgtctcatccaaagtgttgtgttctgtggtatgtaattccctttctggtgactttcttagcctaaaaacggaagccccagtcaattcttaccactctgttcaccacaacacattttgagttcactaaagctccatgaccagagggccccagagagccaccttcttcaagctaagccaccatgtcttctcggccactccactccactgggtccacactgacttaggttggtttctgtcatacaaatacgcatcaaacccaggcttctcactttatatttctccctaatatacacatggaacagctgggtacaatcttctctcagataaacacaagctgtaagtcttccttatttatgaataacagtttgaaattgcttttataactgaatacaaattttattagataaatgcagatatttctgtgtgatcccagattccccagtagccatcctcatctggacagcccctccagggcaaaataaaagcttattaataaccacagaagccttttcatttttaggcaacttctaattctaaagtggcctcttcttcaaactcagagaaaaacctgtcctgtttcttttattatatacacacacagaaaaaaagcctttggacgccttgggaatttttgtgtcttgctctgtacagcttatctgcccacagagatacttcagagaagaaacttgtgacaatggggaattaggcctctttctgtaggcagtaataactagcatttattatggacttagggagtgccaggcatgatgccaattattttacatgcagtatttcacttaacactgatgtcggctgaatcatggcccccaaaattcgtatgttgaaattctgagcaccaatgtgactctacttagagatagggcttttaggaggtgattaaagttaaaggggtcagaaggatggggccctaatcccttagaattggtggccttctaagaacagagagagttttcttccccacgtgagcacagagcgagaaggtagctgtctcaagccagaaagagagccctcgtcggagcatgttcacgctggcaccctgatctcagacttgcaggctgtgccactgtgagaaaaccgattcctgtgaggccacctagtctgcagtattttgttatggcagcctgagctgactgagacatacactcacaagtactctacagattcattgctacggtggtctccatttacagaggtggcagctgtaagatgagtgaatgtaaggagcttgtgtaaagtcccacagagtgagctgcagaggtggggcttggactgacgcccgactgccctgtgtttgctccagtcttccctgctgcactctagagcgcaggcacacagtccacctagatcacagcaggtgatcacagcagggaagtcaaaacaggccgaggtcttaaacccaggtccttcgactcacattgagggtcagtgagcagcgttttcctgttttcttaaaaacagtgataacttcatggcctcatctccaaacaatgttagagactactctcaaaagatgagttgtgaccaagtagaggagatatattaagagacaactaaatggagtgaaataggttacatctcacggggttggctgaaggcacctatttccaaattatgaacaaaggcagaggagcctctagatccagattgagggttccatggataatatgcccccttccaaaaatgcacacagcagagctttaccactattttttatgataattaggaaagcaagctttcaatgagacagtagcatcaccctcagtcctccatgctaagcttcaaatctttctcccactgtcgtcctgatgtctccatttgactgtctcatagaggtgatagcttcacaacttaatcagaactctttattcattcttcaattcctgcctccttaaacccattccttctggcatcatcctcattacaggtagttgtaaaatgcagctagttacccaaatcttcctcaatcgctctctttttctcaatccccaatctcaggaagtcctaactactattcttcaggaatgcacccctcacctctccatcattctctgtcttcattgccatcgtttctggcctctgctgctcctgtcttgccctctgcttctactctgtacccctgcaatctagtcctctacacagcggtcaaagtgatgtgcaaaacttttcaatcacaacccgtctcttttccactgcaatgtctccaacgttatcgcactgcccttagagccaattccaaaacagttactgtgaccttcaaggcccagcgcggctgcaccttcatctgctgctggggctagcgggctacctctgccatatgcctctatggtgtttgtttgctcagctccaaccttcactcagccgatcagtcaggactcaggtcaaatgctccctcttcagagaggcttcccctggctatttgatttttcgctcttccaacatcatcacaccttttcttaatgtatagcttgtagcacaatctaaatatttgcatctgtttactttttatggtctttttccccctccttcaacactgcttacacacccgtgcagaaaagcatgtaataaagctgatctcattaatgactgcatcttcagtccctagaacagtgtccaacataaaataggtgtgtcatacatatttacagaattagtaaataaattcataaatgaataagtaaaaatcgtgttacattttttgtcatttttaaattggtttctttctttgactgttagtcttggttatcaccctctgtgtgagactgatccgtcaaagactataaggcagataatgtcctgccacaagcaagagagttttcacagcccaggatactggttggaagtatccatccatacccaaagcagcagcagtactcagcaggcagctcagtttaggttctgaacagaagttgctgcccaacaaggcccacctcccctttgtctttctccgtaattgtgggttcctgagttgtgtgcaccattgttcagctgcttcttacaggatgcatctcttcagtgtcacgagctacgttccatcaccagacacagtccacatatacataggaatattataggcctacagtcttacttaagccagtttgaaatgcaataatgtgattagactttttacaggtgtttttcccaggtgggtcgccttacgtttcatgtagcttctctggggcattctatcttctccaggttgcagatactacctgtcagtttcaagttgctagagtcacctgaatactgacctggaaatccctagggttctttacaactctttgccttctttgcagctctttctcctacctgagaaagttccctctggcaaggattcctattctcaagcttgttcataattacttttctctggctagccagtggtctctcttgtgatcattacagccctgtaatcgggatacaactttgcattttctgttacaaattgtcataaacgagacttctgtaggtctgagtagaatctctagtttgtacatagggcatttataacctttcactcccatctttttttatgtcacaaatcgttatcatgtgaaaatgggagtttggctacataacgataattcatgattattaaattttccagtgtgccaagtaatttggtgaaatgttgcatgcattatgtcattaattgtcccttatattaattatggtttttatgttctgtattttatgatgctttgatatcctaggtcttgctaattctggaaagactgtccctcctagggctagctaattcctagagatgataaaaaacttgcctgtgagcctgccctttatgagaaaaccaatccatccaaaacccataccccacacatttcttttatctaatgctcacacaccaaatcaatattgcccttgccctagatcaccccagggccaggtacagaaccactagaaccacccccactgccgtaacacagagcctgccagaaatattcaaactttacaatcctaagcttgctgaagtttgcctaccttgcctcccctatttattcccatggaaatcacaataaagaccatgtgctaggccttcctctcactccttctgcctcctgaccaaccctggtgcctccccatgtggtccagcatggcacggtgtgcccctcctcttgggaactgtaaggaataaactcatctttcaaggcagtcgtctctgtgtctgtcttcttaccagccttgattttaaaacatgcccggtacatttcaagaaacctcaaaccctataacataggtgggataggtattcctgggtaccagccaggcagctagagagatgacaagtcagcatctgaacagacaatataacttcaaaagtagtataggttgagcatcccaaatccaaaagctgaaactttttgaggacagacatggtgctcaaaggaaatgctcactggagcatattgaatttgagatgtccagatttgggatactcaacagtaggtataatgcaaagactccaaaatttaaaataattcaaaatctgaaacacttctggtctcaagcatttctgataagggatactcttagtcatgatgttaatttgtctttatatatgtttccacatatctaagagggtttcactaggggccaccgtgtcatgatactcagccaagcatttcctagaaaagttctgacataaactacttagtccttgttcattgtgaacctcagctcattttctgtttctaatttcaatttggtctcagccttatattctataaatgcacagactagtccacagcagtgtcctacagaggaatgaagtctctcccacacaactgtaggctcacagagattaacattaaatgagacctttgcagtcatttctctgatctgctagcccatgagttgagcccgtttattcactcagaaatattgagctaggaaatgctgttacagaaggaaatagacacaggccctcttccttaggactccagataccttatttcaggggagccagctgtgcaacaaaatgggatacttggtttatttctttgcaagagcaagacttattatatattgttaagaaaatttacacctcgcttctgcccatctctgctgctcttctttacttgcctcagccattcttttcctatcgggaacctcatgctgtcctagcctttctctttttccttaataactcttcctgtctcaagcaatcttttatgagttgatttagcaactgctccatttttgtctcttgagaagcaatagaaccagcaggtccaggagagaggaagggatctgaatgccctacaaccaagtggcagagctgcgagccttgaggggcagcctgacccaactccacggctgccacccacctgtgttcaagctccaaactctgcaactgaagaaaatcataagcccggcctcaggttctcagctttacacaaattaaagtatgaaaaagagcctttcccgtctggtgatactagactagaactcagagttgagaggttgaagtacaatgtcaatcaggaaacccgggttcactcaagtcttgagaaaagacatgtgtcatgaaagctagtaggaaatcccaaaataggttgtggggctgctccctgagcccccagcctctcctctctgcatcacaactccccaaagccttgtacctcgggagcttatggatgagacctggaccccactgctgcctttgtcatacctgctttctggaaaggacctaacccagtggatcactgtgtaacaatgctctgtcaatgacaggccgcatatatgacagtggtatagaaaagattacagtggaactaaaaacttctcatcctccagtgacactgtagccatcttaatgtcttagctcaaagtgttactcaggtgttggtggtgatgctggtgtaaacaaaccctactatgctgccggtcccatgaaagtctagcacatgtaaatatgtacagtacataatacttgataacaatataaacgactatgttactagtttttatgtttactatactatactttttatctttacagtatgctcctgctacttattttaaaaaggtgattgtaaaacagccacaggcaggtccttcaggagggatttagaagaaggcattgccatcataggagatgacagctccgtgcatgttattgctcctgaagctcttccagtgtgaggaaatgtggaggcagaagacactgatactgatcatcctgactccatgtaggcctaggctaatgtgtgtatttgtgtcttagtttttagcaaacaaaatttaaaaagtaggccgggcgcagtggctcacacctgtaatcccagcactttgggaggccgaggcgggtggatcatgagatcaggagatcgaaaccatcctgactaacacggtgaaaccccgtctctactaaaaatacaaaaagttagctgggcatggtggtgggcgcctgtagtcccagctacttgggaggctgaggcaggagaatggcgtgaacccgggaggtggagcttgcagtgagccgagattgcgccactgcactccagcctgggtgacagagcgagactccgtctcaaaaacaaacaaacaaaaaagagtggaaaaaagcttagaataaggatataagaatatatttttgtacaactgtacaacgtgtttgtgttttaagctaatgttatcatgcaacagtcaaaaagttaaaataattcaaagtgtataaagttaaaaagttacagtaggctaaagttattattgaagaaagaaaaatatgttttgataaatttagggtagcctaattatatagtgtttatgaagactacggtggtgtgcagtaatgtcctaggcctccattccccacccgctcactgactcacccagagcaacttccagttctgcaagctccgtctgcggcaaatgtcctgtacagatgtaccattttttaatcttttgtaccatatttttattgcacattttctgtgtttagatacacaaatccttactattgtgttacaattgcctgtagtattcagtacagtagcatgctgtacaggcttgcagccaaggagcaataggctctaccatacagcctaggtgtgtagtaggctgtgtcatctaggtttatggaagtacacactaggatagtcacacaatgacaaaatctcctaaagacagttctcagattgtatccccctccataagcagcatatgactatatatgtttcactatagctgatataattagtgataagtattctcccttctaggtaagatgctctaattaaaaattttagacctacacatatatgtgggctaacccttttagaatggggaatggggcagtatttatttgtgctccttctctcagaactgaaagcaagtagtatgcctttgtatccttcagcaactaaagtaataaacgataagagcttaatgcttatttttgaattaaatttcattttgccaattgtgcagagcccagtctaatttaacaaaaggctctgagagaaaatacagtagagcagatgcacatagcaaccattaaattagaatacaacggggaggcttctgccaggggagcggagagggcctcccgaggggcccaagggaagcggagctctggggtttagagcagaaagagacaaatccgagaccaaagaaagggggaggctggcttccaaaagcaccccagtcacctcccagcaccactgcggcgccgcttcctgtgaggggttttaggaggatcagtcctactactttttaggatctggtgtgtttttcccagcccttgctttttaccacgataaggtgtaggacagggacaatgttgcatgctgtgttttaaggagaaattgagatttgccactttggggacaggcgtccagtggaggggcacgggcgtttccgaggtgggtcctcggaggtgggtgcactccacctctgcgcgggcccaggacagcgcgccgtcagggctggacttggctgggcggggagccgttcgcagcgcgatggacacgcacaccggtgccccatctggcgtgggcagggtagttcagctctccagggcggggtttgtcaacttctgcgctggcatcggcgagggaaggtgccagtgtcagttttcagtttgctgctttccccagaactccctctcccgccctcccctctccctccccgctccccccaccccgcccctctgtaggggaagccgctgcgaggggcgccgcgttctctccgctggcgcgggtgtcgggacggagcgaagtgggcgcggtgcgggctcatccccgcaggcatccccagcccggtgggcgcggcggaggttaaggtgggcgcccgcccgtcgggatgagcgcgcagtccgcgccgcccgccagcccgctcgctccgaggcggcaccgggagaaagtggcggtcagggatggagctgctgccatgacaaccccggcggtccgggcccgcgcgcgtcggggctgctcccgggaggaaggcggcgcggaggccgggggcggccgctgagcgtggcgtccgcgcgtccccgcgtctcgtgccgcgtccccggaggaggcgggggccgccgtccgcccagctccccgtgcgcccggagcctgcgccgggcggcgctcccccggctggccgcgagtcgccgaccgggctgcagaggacggccaccgaccggacgaccctggctgcgccggctgcgcgtccccgccttggaactttttgccgccttggggttccagatgcgagacctggggctgggggacacgtacatctgtccatgtgtgtgatctaataaaccatttcctcctctccttgaagccgcagctttttatgacagctcctgtatgtcagagacacttgccttcttctttgggttataaacttttgatgccagagctctgcagaacgtgcccaactgaatcttaaagtagcgtctcgaagagagaggcagagaaagcgcaatctgtgaccttcatccccgcaccttgcttcttcctctcccctcctggccgcctccctcctccccaggggagcgtcaagaaagctctttttggatgcaggagggggcatctggttctgctaggctggaaagctgaggcaggatctgaggaagaattctcagactccggagagcccggactcctctcttctccttccccctgctcctggcgaactctgccccttccctcctccccgcaccgcttcccgagcccgctggtgcgcggggcgggggaccaggactgtgcggctgccggagtcctgggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtagggagctgtccttccgcgggggccgagcccctgggctgtggtcgctggggagaggagggaagagggggcagaaggctccatgggggaccggaacgcgagtgggccttgtgcaggcccgaggggcgcccgcttgcgtgctgccgtgccgactgccgtgcccctggacaggtttgtcctgtgctccggctatgctggtccaggatcttatgcgtgaaccttgaagtccacgtgtgggactccatggttctttgaagccacgacaggctagattctctcctgcttgggcaccgtgatgagaacatgagtgcatgggtttgaaacactggggggctagcctgagccccttggatggctgtcacaggccagaaggtacatgatgaggcaggatcgtcctcaggaccaccaggctagcccttatcagagatgcacctcaaatgtgaggctgtggaattaccagtgtcagcccacggcctgttatgagtctcctcaagacccagcactcgtgccaaacctggtgtagtgctcctagggtccctattgtaaattatgacagcagttttatttttgcagactgggtccaaggaaaggaaacatgtagcttttatgcaacaacatcacttctgtgtgaaaagcacaataggagagctttttgttttaccttaatgagttacagagaatcacttgcatgctccaggcagagaggtggagaatcttggaatatgaacctttggggactggacttgctgcagcagatactttaataaaaatgcagccaccactttccaccagctcagcagatatcatcttttatccctttaatgaggcagttctggtcctaggagacagattcagggacgtcccagcttaactatgtctcacaatgtacacagggcgaatgcatttgccctgcctatgactttgatggttatggtgacaataaaacatcctgacccagattctgcagccaaaatgcctggcttcccctaggacagtgtgacggtgggggttcttcctgttcctcccttggcttttctggtggaacctttcctgcatctagacaagcctctccctggaggaggaaagacctgtctctgggacaccagaattctttttctaagcccaagggtgaagattggattctgccactttgggtgatacttagctggatcttctttttagttagagaacaggtcccagaatcctgtgtgctgtttctcagaagcccaaagcaaatggagaaaaaaggagaatagagaggcccttcctggagatgtgaaggaaaagtcctcctggccatgtgggtaccactcagcctgccccagactagaatgtaatatccctacttcattgcttcaaagaaggtcccatgaggaatcagggaacatttcccaatacgcatttgcagtgagctagttggcttaaagatataagcagcacacgggttataatacatgttaaccaagaaaatgtcagtaaatattaccagtgttcagggatgttgatgctgccacacacctctttaccatctaatgtgccactgggggcaaagaggtctagcattgaataggatctcagtcgtgaattttccagaatcctctgtcctcttcctgtccctcaaaattaaaccagaaacttcaaaacttgagctttctgctttctgagatgcagtaagactattccaccagcagagggccagcttccatctaccaattttttattagctgttggcctgttttcatgatcttcaattctaatgttgagcagctgggcttgggaatgggaatgggaataaaaaaagaaaagctgaatagttgctttttgttctttgcagaaaaaaagaacaacttacatgttctagcataactgttatctgttatctgattgcatggcgtaattttttttttttaagtaagcacatgtatcatgttgattttgcgtctcttctatacatttaccccagaatagggaaattcagcacgttatctacattttaatctctttaaatcctcattctcttagctcatgtcatcttctcttttattattttcttccttcatttttatcagatgctcccataatgtatactttcgtctattactcattattttctttcttttttgtctttatcacttaagtcttcttattccttgattttttaaggttttgatttcactgctaccacagtgtttcctaaaagaaaataaacatcttctgcaaatttctgtgtgtccccatctctctccttttgttttcactcttttgctgtattggtgaagagttctgttcccatcttaacaaacaactgatttgtcagtactctgagggagagtccatgttttcagtttctagaagcccatggcttcaaccccagataaatataccatgttttatttggtggtgttttttgctgtataagctgtaattcttaagtgtggtttcttactcttttgcctccttaaagacattcattagggattcattacctgggaactgagtgttccaagcgcatcacatgtttagattgcaccaaaaaacactgaatgatacccatgcccatcacacgaaagctcttttaatgtggttgtcctgggtcaaactatctcgaatctgtttctaaatcttgaatgaagtcccataaggaggccagagacctactaggaaaagcaaaggagtcacgaaacctgggcctgcctttcactttcccagtgaaaaactgcacagctcagagaagagtgattttcctcctttgggatatcagttttgttgtgacaggtctttgattgctctgagggacattaggaagtgctgtgccaaagaagacactgaagctttgaacgtggatgaaactcgttttctgtaagtgaggcaatattatcctcctcataactacttcatagggttacttgaaaagcaaaaataattatttgaatattgagttattttgccctcttggaagagagatgatatggaaaatgaaggtgctcttcactatggttgaattatagcttccatgaatctgatttgaattcattattacaaatgggccctcttggccagaatcacttcattacaattatctgctgttgggttgaaaatgttctgtggctctgcattagattagatatgacaagaatccagaagtcatgtgtctgaatcaatgcccacatcaggaaaggagcccaggatgttcagtgtggtcagctggtgtctattaagccatctcagcagaatggatgatggccagttgtgctttcttcacaggcctcaatctcctcaaagtttgcttgagttcttctgtgggtccacatcatctgtgtacatgaacattttgaggggctgcggtgagatggaggcaaggtggtggttgtaactgttccactcaacgggaaaagttcccaccaacatactggattttctttctggtttgcttttgttttggtgttttgtgttttttatttcaacagcaggataatcagttttgttgatccaggcttgctgatctgggattatgcttaatggctcttttctaaaatgtccctgcattttcatttggagttctgagctaatccattcaaaaccaagtatttgaggtttaactactgccaaggaataatctgagcagtggggattttgccaaagcaacctgggcagtagagtttccaaagctaaagttctgttgtttgcctgggtgtgtttctgtactttgcacctaccttcagctccttcttatgtaaattaaaagattttgagtagccattagactattcaaaacaaatgcattatttttccatttcagtgtttcagttgtccaagctgaataagaactgggtaaatgcaaagactttactcctagtctgggaagacaaagacattaaaagacactcaagcagggacaggtccataaaggacctctccagtggtggcactaacctggttggagttatctgggatgctttttagaaattccatttccagtctcccagattgatgatgtcaaaattcctgggtttggggatggacgtggccattgaaaacatcttttccagtatttctaatgtggagccaggattgagaacactgctctaaagccctttctggccctagagcctctgagcaaggcttatccagcgtccctgctttccaaggaagcatcttccccatgggtgcctgcacctcatgggcaatgttaatgccctagaaagctctgtgtctgggggcctaggcacctggggttgattcttactctacctctcactaactccacggccttgagcactttcagttgaattgtgtacatacaggaacaatatctattataactggtctgcattatcagaggaaaggaagtatatgggttgttctgtgagccataaagcaacatatgtgtgcaagttattactggtactaagttgaactcctcaataacaactgacaatactcacacatttttttcagttttgtctgctccatctcgttcttcctctatccccacacttatacacagctttaaagtatatttgttttttcacagttccacccagaattctttctgcttgtcaagaattgccctcatgagagttccagtaactcttgctgctaacactgttctaacagatccacactaggacctgttattttttcatgtgtggttatggttagtctgggggctcctggagcttaggagctgtgctttatgtgttgactatagatactgtggtggatactaaagattacaacaaataagtattggtttaatgctttaatccatcttaatgggaaacaaccacttctagtgtattattgcctctacagcaatgaaacccttatatctaaacaattttattgtcttcaaaatatgatcctgggatattcaggcacagcagttggttagcggtcttggaggcctgagggacttttggattccactcaaatcacttgccagaggggacagttgaatccaccaatgatggcagtctgatccaaactatgcaaagtcttcactatccctgaggtcaagaaaacaagcagagtggcagagtgaagagcagtagtactagtgctttttagaagcagtagaggagcacatttggaaagcatacctgtctctgcagagatttgccttgtgggcccaaggagatacacaatgcagggaggcagcaagaatgttggcatgtcctgggttgggtcatggctgccggatctggcaggcctgggagagcaaggctggcttgagtccgtgacactctctgacatccctgattggtgggaatgtgtctgcctccccagcacacacacacacacacacacacacacacacacacacacaccccacacacgccacacacaccacacacacacgacacacacacactccacacacacacaccacacacaccacacaccacacagacacacatacacacacactctctctctctctctctgtccccctgtttgaagcaggctgtgggagaagacgttttaaagcattagaaatatatgttccctggctttctgaacctttctggaaaactcagcagctcttatctaagccctttgggtaattgtttaacctttttaagtaaatttggcccttgggcttggtttaggtctgtctttctcatttcctttccttctggtttctaaaaaaggactctgcccttggcccactcactgtgctcactaggtggctggctctgagggagctggggagccggtccgccaggcagtttttatggatctgatgggatccggcagcaagatgcagtggaggggaagagtcaagcaggtctcatttgaccttcccaggggaggtcttttaaaattacttattattaacgggaagctgtcttcagtcatgagatgagaagagggaattacagtccaagatatctttagggctgacagaaatttgcattgcctaataagttagaaaccaagtgctaacttttcttcattttctttcttccttttttttaacatatacaagacagcaccaaattatttcaggtctgtttgtttattgtttgccctgaatgaagccgctcttgctcatgttaggtataattggagctcaagtttgcatgaaatgggtttgggggaggggtgcactcttttcatcttgatccgttctcaggcccttgttgtctcccaataaatgacactacctacttgatgctttttatacctggtgtattttcttttaagaaatgaacattgaagctgtgatatctaggctgctcagcactgcctagcctagatctgtgtatggctttcccggtagagaagtttagagaaaggaactgtctgtacctagcgccactacaggataatactgcagagccttgaacaaaacctgcaagagcccaggggtgaggggaggttgtggggcggggacatgccgatgctagtgaaacaaacaaaagctcctattgtacatggtttactatgtgtcagatgccacattaattacctaacatgtcatgtaattttcagaccattacaatccctattaacagcctacgggtccaggtttagaaaagttaaaccacttacctttggtcacatggttatcatgtgtcagagtctgcatttgctcctagaagacctttatgcttcttttcaaattcatagtatgtccccctccccagatgtagaggacagagaaaacttccaagtgccacaagcagaaataaaccaaacacatcctttctgttcctgaaggtcaggaaatctgcatttcagttgaaggctgcagctgtctgctgtcccatctttagagtctccttgcttcttgggggcttccctcccctcacccgcactcaagtgaagcccatctattactaccttctgaggctggaaatggtgcacgctgcaaacactgagcaacatgacacccaccaggatctaacatactgtccagggggatcatggatgctcatggctttgaacctgccctaaatgttgtactatcccgttacttgacctcccatagcacatatggaacctcaaagggcctgcaacctaagacaacgtgagccggtcacttcttggtaagaacccaacaatgagacctgtgaagaaatgagtgataccaaagtatagaaggaggagaagtaattttgtttaaaccctaaaatacgtcactccattatcctccctcccatccttgtattcacattttaatttaagactgtgaacacagagagcgcaggccttgccatgcattcataccccagagaaaaccatgtgactcgctttgacttgctggtccctggagatacataatacttaaatcaaagagatgctgaaggtcttgacctggcttcccatgaaagtgctgatcaatacaatttttagaaattggttttgaatattaaacattttcagtggatctgaagatttatggcatctcaattaatcaagtttccactgcataatcatcataaagaatgttatcagtggttgttaagttttctggctagtccacagaagacaattcaactcacaattacccaaaatgctatacaccagcaatgaagaataacagaaaacaacgttgttgcagaagtaattacgcaaaagagagaaaaaagaatacgataattttctatttattgtgaatgccaatgctgaagaaaagtaggcgtaattagaagaagataatatggaaacattttctcaaagatatttctgaatgctctctgaagttttggagtttgttgtattgtttctattgagccaaatttaattttaaaatatgtagctttttttttttttttctgagatggaattttgttcttgttacccaggctggagtgcaatggtgcgatcttggctcaccgcaacctccacctcctgggttcaagcgattctcctgcctcagcctcctgagtagctgggattataggcatgcatcaccatgcccgggttattttgtatttttagtacagaaggggtttctctatgttggtcaggctggtctcgaactccctaccacaggtgttccccccatcccggcctcccaaagtgctaggattacaggtgtgagcctctgcacccagccgcttttgtattatttgattcctgtatgcatttgtcactactctgatggatgaggaaattttcataaatattaacaaaggaaggaagatagataaaggacagaaaagacaataatggaattactcatgaaaggagagagtagcagagagatattccagaagtagaagttgaaaggaaggaaagaaaggagctaaagaaggggacagtgtgtacctgtgagaaaaacagcaacagcaacaacaaaaacctcaagtggaattactgaatagtcagaggtagagaaaagaaagaaagttggcagataagaatgcctgggccctacttttgagtttctgggatttgagagcctcttctctgcctgtccaggccacaggaccacacataacctgatgtccagcacccattctaagtcaaggcgagaacagtcaaagggtcagttctcacttgctgctaggttccagcgtgttctgaacctcggttcctacctgccttacagctgtaaatctccctcttgtcaatgggtcttagtccctgtattgctaatccacgctggacctaccccaggccctgggtgactgggtaccctgccttgtcctgccaggatctcttctctgagggtcgaggcctgcccttaaccccgctctgactggcctagtggttccaggactttccaatgcttaccatctgcctatttacccaaaggatcttttggagagcacttcacatccaggcagcaggggaggtctaggccaagtgacgcttgctcctgtctaccctgcttatgtgtaattaaaccatttattttcaggcacatagcctgtgtctcagttattggtccaccttgactatccactgttgcctcctggtcattgtttggaacctcctgtgatggagaaaaaaaggagtcaccatctgtacacccagggaattgaatgagtcaggggtttattagagaggctgggcttacactgagatattgtctgtaaggcaccctgtgtaagaggggggaggaattacagaactcaaatttgtaccgccgtgtgcttttctctgccatctctaaagatattcctcttccaattgtcatttttattgcttctcccaagccctttgttaaatgcattaatatcttctatctatcttgcattctcagtgtccaacagaatacctaatgcttagtaggtgctctaagttttctgaaaagatgaatgtttctcctttatctctatctctctgtctctctctctgtttcttctctctctttctcacacacacgcacacacacacatctcccttttctaatgaagatattctcatccatgttgaataattcacaagtcactgaaattacaaccatagggcctggcatttgaaccctagttgagatactaatatctccctaaatagttgctgtttcacttgtcctttctctgcctgcttgttataattggaggatttgacaattgcacaatatcattgaagccacaggcaggagattctgaacgatttgcaagggaggaatgtctgctttctccccttcatcaaggtcacataatagaggctggcacattctggaagaatacctgcaaatttcagggtttggaaaagccaatgtgagtcatctctaaacattccatctcaggatgaagggattcatggacccatctccttgggtcctaaaatgcagctgcttctgtcacaagatctcactatgaggtccctgaatacctatcagcaacatgcctcccgctgtacctgtgcagtggaaacagttcatagaatgtccttgattatatgctctgctttatgatgggcgagtcaatgggtgcttagtgaaatgtaagataaagtataacctctatcaagaggttaagaacactgactttacagtcaaaaggctcattttgaatcccaactctggtacttaatggctgtatgtggttggacaagtgactcaatttttctaagcctcaatttcctgattaaaaaaaaataaggaatagatatccacttcactgggctgatgggaggcagtaaatgataccaagtttgtaaagatttcagattaaagttttacattgcagcaagagcacaataaacagttgctattaagttaaatatatatatttatccatgcagcatttgtatatatatatatatatatataatatatatataactgaattcacaatttatccatgcagcatttattgggtacccaccagcactattctaggcagtgtgggaattacacagttaaattaattctagactctcctctctgagcatccatgtatgttgaatatgtgactatgttggcagaacatagagcccacaaaatgggaaagggggatggaggaagagagagggataaaaagagggagaaacgaaatctgcttaaagtaaaacgcaccctgttagggttcacatcagtatacttggacgcatatatttacccatgtagccaccacctcactaggtacaaaacatttttgttaccccaaaaagttcctccatgcccctgtttttattgtggtaaaaatacgtagaatgtatcatgtaaaccaattttaaatatacagttcggtggcattaagtacattcacgttgctgtgcaactgtcaccaccatccctctccagaacttatttcttcttcccaaactgaaactcagaatccattaaacaataactccccattcttccctccccccagcttctggaaactactattctattactattattactattctattgtactacttttctttctgtctctatgttttgaccacactaggtacctcagataattggtattttatagcattcatccttttgtaactagcttacttaagttatctatacatattgtctttaaggttcatccatgctgtagcatgggtcagaatttctttccttcttaaggctgtgttctattgcatgtataggccacgtttgtttattcattcatcctttgattgatgcttggattgcattcactcttgtgaataatgctgctatgaacctaggtgtacaaatatctgtttgaatcccagctttcaattctggattgcatggtaattgtatgtttaatttttttgaggaaacgccacgcagttttcatagtggtagagtcattttatattctcaccagcaatacagaagagttccaacttcaccaccttcttgccaacacttattttctgtttctattattttcattaatagtgactttaatggctgagaagtggcatctcactgtgattttgatttgcatttccctaatgattagtgatgttgatatgcttattgaccatttgtatatccttctttggagaaatgtctattcaagttgattgcccatttttaaactggattgtttctttgtttttcaacgtttgtagttttatatattctggatattgacccttatcagatatatgactcacaaatattccctcccattctgtggattgccttattactcttttgatagtgtcttttgatgaagaaggctttaacgttttactgtagtccaatttatcttttcttgttttttccttttgtcgtctgtgcttttggtatcagatctaagaaggcaccaacaaatccgatctcatgaagcttttttcctatcttaaaattttttttaatagttttagctcttatgtttaagcctgtgatccattttgagggttttttttttgtatatggtgtaatatgagtccaacttcattcttttgtatgtcaatatccagttttttcaacaccatttgttgaaaagactgtcctctccccactgaatggtcttggtatccttgttaaaagtaatttgagcatgtattcaagggcttatttctgggctctgtatttcattccattggtctgtatgtctgttgttatgccaggaccacacaattttgattacagtaactttgtagtatgttttggaagccaggaagttccagaccactaactttgtttatatttttcaagattgttttggctatttccagtctcttgagatttcatataaattttaggattgatttttctatttcaatggcatgggtagattgctttggattgaattaactatattaagtctaccaattcataaacacaacatgtcttttcacttatttttgtgttctttatttcaacaatgttttgatgtttcagtgtacatacgactttcaccttcttagttaaatttattcctaagtattttattcttcttgatgctattggaaataaaattttttttatgttttcagattgtttattgttagtttatagaaatgcaattgatttttttgttgatttttgtattctacaatgtaatttattagttctaatttttgtgcatgtttatggaatcttcagagttttctacacataagattatatcatctgtgaacagagatagttttacttcttcctttccttttttgatgcttttatcatctttatttttattttttgagacagggtgccacactgtctcaccctgtcacacaggctggagtgtagtgacacaatcatggctcactgtagcctcgacctttcaggttcacgtgattctcccacctcatcctctcaagtaactgggaccacagttgcaggccaccacgtcaggctaatttttgtattttttgtagagacagagttttgccatgttctatagactggtctcaaactcctgggctcaagctatctgcctgctttgggatcccatagtactgggattataggtgtgggccactgcacccagcccgtctttttctttattgcttcaggtagaatgcccagtgctatattgagtagaagtgatagaagcagacactcctgccttggttctaatcttagaagaaaaactttccatcttttctcatttagtatgttgagtacattttagtagtggaatttttacatatgacctttattaaggttatgtaatttctttctattcctagtttattgagtattttttattattaaagggtgttacattttgtcaaatgcattttctgtatcaattcagatggtcatgtgttgttttgttttttccttcaactggttaatgtggtatattcattgatgaaccatccttgcattgcagaaataaatctcacttggttatgagtataattcttttaatatgctttgaattcactttgctgacattttgtgaaagatttttgcattaatatttacaaggcacattagactagtattggttttgttgttgttgttgttgttttggtaatgtcttcgtctgattttgttatcgaaataatattggcttatagagtgagtttggaagtgttctctcctcttgaattttttgggagagtcataggaaaactgttaattctcctataaatgtttgataaaattcagcagtgatgctatctggtcatgggcttttcttttttgggaggttcagattttcaatttctttgtgattcagtcttgacagactctgtctttctagaaatttggccattttatctaggttaaccaatttgttggcacatacttgttcacagtactcttttataatccattttatttctataaatttagttataccatgacctttttgtgattttagttatttgaattttatttttttcttagtcaatctagctaaagttttgcccattttgttatcattttaaggaaaaaactcattattttgttgatttttttctattttcccattctctattttgtttatctctcctataatatttattattttctttcttctgctagttttgtgtttagtttgttcttcttttttttagttccttaaggcttaaaattagattgttgagtgtttttttttcttttttgttgtaagtgtttagtgctatgaatttctatcctaatactgcttctattgcatcctataacttttggtatgttgtgtcttcattttcatttgtcacaagattgttataaaaattgtttttttattcattgattgtttgagaatgtgttaattcacacatatttgtagattttccagttttccttatgctgttgttttccagttttatttcattctaataagaatagatacttagtatgatttctgtctttttaaatttactaatacttatattttgccttaacatatgatctatcctgaagaatgttttatgtccacttgagaaaaatgtgttttctgcctttgctgggtggagtgttctgtacatttctgttacgtctaattggtctgtagtgttgttcaagctctttatttccttattgatcttatgtctgtttgttatatctattattgaaagtggagtgctaatgtctcctactggtcttgtagagcaatttctctattcaattctgtcaaacttagtttcatatattcagatgttctgctatttagtatatatgtttatttttttgtatcttgttggtaaattggcctctttattattatataacatcatgtgttttttgtgagagttttgacttaaagtctattttgtgtgctatcccatagccacctctggtctcttttgtttactatttgtatagcaaatactttttcaacctttcacttttgaactatgtgtgcatttaaatctaaactgggtctcttggacacagcatatagttggatgctgttttttaatccattctgccaatctgtgtttttagattgtgccgtttaatccatttacatttaaagtaatcactgataaagtaatcactgacttactatgctgttttgttatatattttttctgtacactttatagtttttttgtccctcatttcctcctttactgccttcgtttgtgtttattttagtttttggtaggcttgcattttgattaattctcattctattttgtgtatattctataggtattttctttatgctatatccccatgatttgcacatagggcttatatacaatatcctaaggttagaaaaactattttaaattgataacaacttaaattacatacaaaaactctactcctggacagcttggatccccctatatgttactgatgtcacaaattattggtttatacattgtgtacccatgaacatagatttattattatgtatagttttatattttaaatcctatgaaagaataaaattggagttataaactaaaatgacaataatacaggttttttggtaggtgtccatatattatatttaccagagaactttatattttcatacaaatttaaattactttccagctttcttttgtttcaacttgaaggactctctttcatatttcttgaagtgcaggtctagtggtaatgaattccctcagcttttgtttatatggggatgtcttaacttctctcttatttttgaaagacagttttgctggatatggatttattgggtgacagatttgtttgtttgtttgattttgcttttgctttttccttttagcacattaagtataaaatccaccgccttctgggaggcaagatttctgctgagaaattcaatgatgatcttgttgagaatcttttgtaaatgataaattagtttcttgctactttcaagattctcaatttctctttggtctttgacatttttttataatgtatctcactgtgggtatccttgggtttatcctacttaaagttcattgagcttcttatatgtatatgtccatttctttcttcaactttggaacatttccagtagttacatattcaaataaactcttttcctttctctctatttcttttcccggaactctcataatgcatatattggtctactttgtggtgtttcttaagtcccttaggctttattcccatttcttctttctttaatcttcagactcagtaatttcaaatgatatgtcttcaagttcactgattgttttttctgcttgttcaaatctgatgtatttttcagctctagaatttgtttttggttgttttcttattctttttctattatttcatcccttttttcatagtctaattttattcatatattgttttcatgattactttttattatttcttatgtttttctttagctctctgagcatatgtaaggcagtttttataaagtcttttcaggtaagttttaagtctatgtttcttccggaaaatcttatggagattttttttttcctttgaatggggcatattttactgtttctttgtatgcctagtgacattatgttgaaaatttggcatttgaaaaaacaaccacctcttcaagtctttgtaagctgcctccatgcaagggaagaccttcactaatcagcaggatgtgatggcttaagttcttaggccttttcttggtatatgcctctcctggtcttgtgtgcatcctttttttccattcctgtatacacatggctatttttaaatgtctcaatttctcaaagagtctcactacagtttcttctcaggggccttaaatgttcttttatttttctctgcaagtaatctcttgcagaaggtatgctgtcttgatgcgtaccacagcctccccttgcctgagatccaagctgcttttggtttctggactctgaggtcgtcatcacagagatcaatacagaacatgcctctgacatctttagagttacaatctagggtggaaagacaggtaataaacaaggtaaatgcatctaaacacaatatcatgttacacagtgatgagtgctctgaagaataaaagagtagggtaaattagttgagagggacaagggtctctattcttgccatggtggtcaggaaccacgtgtctgatgatggtgacatttgagcagaaacctgatcaaagtgcaaaagtgagctatgcaaacacctactggaagtgttccagggacagggatggcaagggaatagggttcatggcaaatgtgtgctcactgtgttctagcaacagaaaggagagactgggccagaataagcaagagaatgagtggtagggaataacagagtcatggacagagacttctaccttctggtctgacatgtaaggagcttgggggctggctctccatcctcacaacaagaaaaaaccctcaacacactgaaaatcaacaattcttctcagatccgtcagagaattgaagtcataggataaggccactaccttaaaaactagagacaggtagatacagagattcactgtttattttgggcagaaaccacccagaaactacccctggagtcagagtcttctaggatctttaaaaagaccattgagtgatggctgaaaactagatgtagactaacttgaaatgtaaaacttttgaataagtccttgcggagtccccatactttcgtgggttttacctccagaagccccaccaggttctcagggtgaaaaggcgtaggtacagcagggtaaccatttggaaacattcccagaggattctgttcttcttaacaaaagcttattcttgaaagaaactattttcccacagcctaattacattgttttttgtttaaaccagaacctatcccactgcaggatgggaaataccctactttaccccacactagctaaaagccaaaaaacagagttcgaagagacagagaaaacatcagcataagactcagatatggcagggatgtttgagctatcacactggcagtttgaaattactgtgctcagtgtgctaaaggaatattgggaaaaaatggacaacatgcaagaagtgatgagtaatgtaagcagagagatggaaattctaagaaagaatcaaaaggaatgctggaaagaaaatactgttacagaaatgaagaatgggctcatttgatgagctctttggtggactggacacaactgaggagagaatcagtgagctggaaaatatgccagtggaaacctttgaaactgaaaagcaaagagaaagacttaagaaaacagaacagaaaatctaagaactgtgggatcataacagaagatgcaacgtatgtgtaatgagatatcagaaacaaaagcaagagagaaagaaacagaggagatatgtatagaaatagtgactgagaatatcccaagattaatgccggacaccaaaccacagatccaggaatgctcagagaacattgagcaggataatggcaaacaaacgaacacacaaacataacagcctatgcttaggcatatgattttcaaactgaagaatgtcaaatgcaaagagaattatttggaagatactagcggggaaaaacaccttgtttatagaagagtaaggataagaattatattgaatttctctttagaaaccaagcaagcaagaaaagagcagggtgaaatatttaaagcattgcaagaaaagaatcatcaacatagataaagactttctcagacaaacaaaaattgatcagatttgtcttcaatagacttgctttgcaagaaatgttaaaagttcttcaagcttggtgcagtggtatacacctgtattccaaacaatttagaaggctgaggcagggagtatcatttgagcccaggaatttgagtccagtctgagcaacaacagagacctagaccccatttcaagaaaaagaagaggaggaggaggagatgattaacttaagctagttctgataatgccgcaccccactccatcctccatcccccaagcatttacaggtgtagctgactctttagtaatcagattatttatttatttttacttcctcttttctctctgtccctcttcacatacacacacacacacacacacacatagttttttttcctcagttgatgttagtttcttgagggcaggaacaagatttcgatttaattaggggctgggcgcagtggctcacacctgtaatctcagcactttgggaggccgaggcgggcggatcacctgaggtcaggagtttgagaccagcctgaccaacatggagaaactccatctctcctaaagatacaaaattagctgggcgtagtgacacaagcctgtactcctagctagtcgggaggctgaggaaggagaattgcttgaacctgggaggcgggggttgcggtgagccgatattgctccattgcactccagcctgggcaacaagagtgagactctgtctcaaaaaaaaaaaaaaaaaaaaaaaaattcaagtaacttctgtgatacttcgcagggcatgttaataatgtctgtttgacagaggcaggtagattgaatctattgttagccctatcttcttcccagctgtgtaagtaggtgcaatcagacatgtatatatttgtgaccataacaaaaatggaaataatagtgaacataagcaacttttatttgtgtggtaatttgcaatttgctctttcttcctgaaaagttatttcccaacctctttctatatatgacaggtcttactcatctttcagatctctctcaaatgctacttccaatttgttaatattttctgattttcctgtcacctttgtctcaatggtttataggccttccaagcccggctgggcgtcatagtaatccaggaagattttttagaatacagattcccgtacccagtctcagatatacagaatcaggaatgcttaggtacaaatccatgagtctggttctcatacaaggaaaactagtttggtgcactattttttggaaaaaaatgtgtctgacctttttagtgttttctgtttaccagagcatgcagggggaatgaactagttctcttctcatacccccggaatgtatatactgttaactgtaacataatcttgcaggttatccggccatattattattattattattatttatttatttatttttttctgagacggagtctcactctgtcacccaggctggagtgcagtggtgcaatcgtggcccaatacagccttgacttcccaggctcaagcgaccctcccacctcagcctttggaggagctggcatgcaccaccacacctggctaatttaaaaaaaaacaaaaaacaaaaacgtgtagagatgtggtctccctgcgttgctagactggtctcaaactgagctcaagagatccttccacctcagcctcccgaagtgctgggattacagacgtgagccactgtgtgcagcctctcccgctgtgtcttcccttcacaggacttcgttcctgggagggaaaatatttagttcacctctgtatctcaagttgtgagtacaacaattttttgctttactctttttgttaaaatgtaccaaaaactccactcaagctgtttaaataaagaggtaggctgtgttataaggaccatggaatgcaggagagtgaagaattttggcttctgaaaggaagggaagcaggagtcagacccttctcagaacagaggcagccactctgccgccctcctctttcctcggggtctcctggtctcggtgctccgtcttcccgcacacgtgctgcttttgctcctgtggctttctctgtttgcacagggtggaaggtgcccatccgacctcttttggcttcatagttctcgttcaagcgagtctccacagattgtccagtatttctctgtctcatttccaaatttctgggagataaaatcagattgtctcagcttgggtcgagggtctactcctgatccaatcaagccatgcttaggggcaaaagtcatgcctcagataggatgctcttaacaccaaataataaaatgtaacattaaagatatgtaaaaaatggtaaaattggccgggggtagtggctcacatctataattccagcactttgggaggccgaggcgggtggatcacgaggtcaggagttcgagaccagcctggccaacatggtgaaaccccgtctctactaaaaatacaaaaattagccgggcgcagtggcaggtgcctgtaatcccagctactcaggaggctgaggcaggagaatcgcttgaacctgcgaggcgaaggttgcagtgagccgagatcatgccactgcactccagcctgggtgatagagcgagactctgtctcaaaaaaaaaaggtaaaatttatagtctcactcaatggagggcctcaataaggtgctagagcgaggcagttccaggaatggtttccatcagctaaagtgctgacatcagcaccttttatggctacaagatgactgcagcagccccagacatcaccttctcatacaacaaagtccaaatgtagtcattaagggtttgtgggtgtcttataaaaaaatttctccagaatttctctctgagcagggttccctgtgggatcattggctaggatcccatttatgtccaggctctagctggaggagctagggtcctggaaagagggtttctggcattccctccctcctacccatacttggatgaaggatctgtcagcaagttattagtgagaaattgcagttgggctggcaaatagtaatgtccacaagccccatgccacaaatgtagtccccacacattgtgctatggctgggggccatggaggtggaggtggtcagaattcttagagaaggatgagcatggcctggaagggcccactgtgggtgtttctactggatttaacacacgtgcaataaagggacaaccaaagaacgcacgtccattgcattcactgcgtcgtggccttaccgtgatcaaaagccaaacagggaggcgaacttgtcttccatgatcacccatgatgtctgcagcaatctgtgtcttaagaaaaacaaaaaagctgagggaaacaaggtgacaaacacgagggttccaggctgtcgaaaggaagttttaaacaacctcacacagtactatcaggaaagaaaacagccatggtagaaggagatggaaaaagaaaaaagtgatgaagcaaggccagcatgtggcggggagtagaagactgcagggagaatcagacgcagcgggaagcactggagctgagggggtcaggcaaggaaaacttcttaaatcaagccgagtgcaggaagggactggctggaagacaggagggacaaggtgtggggaggagatagccgagattaatgagctcaggagacgccaggtgggctcccgccggccaggccgtgacatgacagcacgggcccagaagacgaccctctctttcgaggtcagttatttatttattttgcaacagaacctaacaaattctaaaaccagataaatccaattacccgtgttttgccttcagggagtgcgaaagattaatggtggtattttggcagtagcataaaaagaaataggaggtaataacaagaagggctcgtaaagcgcctggagagctggctgcagctctctcccaggggccgcggctgtcctggggccatgtgtgcaccctggcttcggaggcagtgggctgggcccagagagaccctgtccttctccaggggggctgcgatccaagacagcacccagagcacccagtgtccttttaactgatgtagcttttcacatgctcttttgccctctcccgcaaaccacagtaacttttagttttagtgtttagagccaacgttctctccacttcacagatgaggagcctgaggaaggaagctgcaccaggaggtgggatgcagtccatttgcatgagtctccttttgtctttgtagttttgtcctgtgaagtgtcactgcgttagactcccaggtctttgcagcatagcttttggcctatgaaatgtttcttccaaaatgccttgcttgatattcacacattctgctttttaagaaatgtaattatttttattgagatataattcacatatcataaaatccactctttaaaaatgtacaattcagtgggttttactatattcgtaaggttgtgcaatcatcaccactatctaattccagtatattttcatccccactaatagaaagcccaaacccattagcggctactccccatttcccccttccatctagcccctggcaagcttcaaatactttctgtctcaatgaatttgcttatgctagacatttcatgtatgtggactcgcacaatacgcattctctgcttttaacttgtcttttatttatccattctttcattcactcacttcctgtgtcattctttctacaaatgttctttgagctcctgtcctggttcaggcattttttaggcactgtgggtggagatgaacagcatggcctctatctttaaaaagcttgtaattccgaggtgaggagacagaagcgagcaattcaacacatcacggtacttgctgagatccactggaaaggggcacgtgtgtcatcaggctctacctgattccgatggttctgttccagagtttcttcatccccaggatcagccctgacaccagagaggctttgggagctgcagccaatcgccctggcacccaacactgctttctgtgattctagctcagctctaacattggaccctaactcctgagaacagattccacctaattccacttagcactcttcattctaacagcttagaccagtagttcccagacttcagcctgggtcagggtcatctggaccctgccgggcctcaacccagagcttccaactcagtaggtctgggtggatgtctgcacatgtgaatttctcacatgtttcccagtgatgctgatgctgcttgtccaaggacccctctctgagaaccactgtcttagaacatgcctttaccttgttggtctgcgtcctggtagcctgcctagtaaattaatttccctgaaactgaggccctggctttctcttgctagtctcttttcaaggaccaaaaccttgtgattaaatccaggcttaaggctataggcccaactcattatctatctacttatactctcaaatgttgcctatttctgggtttgatggtcttctcagttgccagtgaatgtactgaatcttgccacatctcatgtttcctagttctgtctattatgttttaccattatccacagttagctcctaggcttaattcggcctgaatttttccaagcataattaattgagtcatacacaagtgtccaaagataagacaacagtcagtccaagatgtcattgtattgtttcctaatcccagctttcctatttcataaggtggctatagtgacaaaagtgacaatgttttttttcaaccctggtgctttatgttggcacgtgtaagttgagaaaaagaatgtgaaatagacacctctatagcctttgtaacttaaatgtcctctggtaagattggtggtgattggggaatcataacttagaatgtcaaggttcttaagagtttaagaaagatgaaaaatttcagttaaacctactagaaaaaattattggagatatcataaagtgtgataaactgacttaaaaaaatcaaagacccctgcttttgatacactcatttttacttttaaaaaggaatgtttcccagacagtaaagtgcacacgctgtatgattccaattttatggagctcaagaacaggacagaacaaattaatgatgatggaagtcagtacaggtgctgcaggaggtacagggaagcttgagagtcaatacctacaaatggacgtgagaagaacttgcagcaggatgggaatgttctgtattttgatctgggtgtggtcaaccaagagtagatgtgtagaaaaatcactgagctgcagtcttaagatcagtgccctttatatgcacttcactttatgaatgttattcctcaataaacatagtactagaaaaaagggatacaaaaacagtttaaaacgtgaatgttaaaaatcgcattataaaggtaaaaatcatattttattcatttaattaaattagtaaattaaagattacattgtgcttttaccttattgtgaggtaatttccaacaccagtgacatagaactaactctaatcataaaataggaaaacatattaaaacaattttttaaaagtggccactccacacaagcatggaggtagaagtggatgagtttcttccagaaatcatggagcaccatagattaaaagcttgttttctgtataaagacccagtggatctagtctcatttctttcatttcagggcagaagtacaggagtttgaaatgatccaagtaggccctccaattacattaatcaccaccacagcagaaaacccagcccaaagaggcagagatggataagcaagccattgtgctacttcatgttaaggaaatcagagcgttccccaggtacagtagtgagcccttcatgtagacaccagggaagggtgaccttggccaatctagttccaggtaccatggcaacaagaaaacctacagcttctagacttagaatttctttggagggaacgaggtacctcagaacactgttaattttcttctttccccaattcccaggaagaagcatctgtctcccagctccattaattgctaggccaatgttggatctgtctgggatctcttcagggcctgaaagaatccctttcagagcatagagaggaagtagcaagtcaggctgagcagaaaaacatgctaactactccagagtgaaccagagcatatattcctgatgcccagctttcaactttaatcaatagatattaattaacatagagaacaataactgtcttattaaatcagcagtgataaaaaaaggccatagctactattgaatgctaattgtcccttgatgactccacagagtttctagggtgagcaggcaagttataatacagtgtttccaatacaagccgtgatgttaaatcctcgttacggtgtcttaataatcaattggactagagcgtacggtatttgtctaattaactccacattgacactcaggagccagccttgctagccacagatgatggattagttatggtagcttgggcttggtcactggaaggggtgcattctctaggctctgggggactcatctccagggaccagtgtctgcaaaacaaactctgggacctcatgggaagctcctttcatatcttacaataaaataggaaggggaagactcatgctgccttagtgaaagtttaatttcctacttagtagaaaggtctaatgtgtcgtctgtcttggtaagcaccccatgctgctgccgactgcagtaagatcctcagcccctctgtgaagggaggaggcagggtgagggtagcctcaactcttccctttctactttgctcactcgaacacccctacaaagtcttagatggtcttctatgacattctctttacttaaacactcacatagcctatttcctcttctcttccggtgacttctacctctttattctaccaccttccttcagccgccaaagctctacgtgtactactactctgtgcaagttttcatatcctcatggtgcatcttcttttattctgctttctttccaggtttactgtctgggatattcagattgtgtgttcaagcttaggaactgtgaattttacttacctgtctccaccttgacaactctaatgggaattcagtgacgtccatgcctgtctagagtgccagcgcatccacagtagaaggcttgccactgactccgtttttcatgtttcacattgatacagcttgactaggccatggaaccccagagtcatggagaaaaggggccctcatgggtggggagagtcagcacaaatgcctgacaagagggagtctctcttagtgtgatgagactgtaaagctgatttgaattagtgtcctatttccaaggagtataaagaggcttataaggatgcatatatatgttaccatcaattagaaatgggtaaaactacactttatactacaatcaaaaagtaatagcagatggatccgagatctgaatattaatataaatatgaaacttctgacagcatcagaaaaataaagaattttacccatacatgcacacttacaaaattatggaagttgtgaaatgttttgtaattaagaggaaaaacccaaaagcaataaaggaaaagactgatatattgatagattggcctaattaaatatgaaagatctctgtagaaaagataagcagtagactgggaaaacatgattagcaatatttatagcattaatatctagattatataaagaacagtcacatatcaccaccaaaaaaagataaattactcaatagaaagtagacaaaaaatatgaatgagcaattacttgaaataaaatagtgaataaatatgtgggaaaatgctgaaccttatgagttatcagggaaatacaaattaaagcactaaatacaaattacctctcaaaaatgaataaaaacagtttgtgtcactgaggactgtagggaaaggtgacacttacacactgctggtgagattatcaatgtgtgagtcttttggagacggtgattgtccatatctatacaaattagagatttgaatgctgattgacttttggtcccaggctctgcagggggaatttagaaaaactcttgggatgtacttctgatggtccaatcccagaaggagtggtggctgggcaaggctgtggaaactgcctaaatggttgcacaggctgaggtcttgccagccttcccatgtcatgccttgcagctggtgtgagaatgaggtatcatagcacatgtggatgccagaaatgtgcatgcctcaccgggaggtaaaaagcagattgtgccacagtacatatgacatgtttataacccagatagatgtgtatacacgttcacatatataatgttgaaaatggggagatagggtctggtggtttacacacaagcaagaaacagggcccctgaagaggtgaatgagaatgaggcagcaaggtaaagatgggatacacatgttctgtatacttctctattactagaaggtcatagatgttgagttaatgtaattttaaactttttgttagaaagaaaaggaaaataagggtaataacataaagagaagaacaaagctcttgcacaggccgcaaggttgtcagacctggagggcaatgtgattggttatataacttatagcatttgtctcataaagcaaatcagctgcagggagcagcatcaggagctctcacacaaagaccacacagagcttcttgagagtcacacaaaagaccttgtgttgtgtaatggcgtatggaattctgctgcaacactttcttagccagctccttggggctctggtttcacactgcctggaggatccccatcccgtctcccaactttgttcatgactcagtggctgctatgggttggtacaggaatcagccaaaccacaggcagttcgacatcctggtcttgcaaggtgccctgttgaggggcagtgtgactgaggtcaggtaaagagcccgccttccagcacagccgttcactctctgctgggactctggtttcttagtctgctttccatttcaaggattaaggacaaagggataaagacatcatggccataactacaacaaattttaatttctggttatttttccgtatacagaagcaagacattgggtaacatgtagtaaatctaaacgagtccataaatattatattggaacagaaaatgtatggtcacaagagacgaaccatattaccaggtcgtgtaattagatgtgcaaactcagttgcatataaatgttaccaagttcagaatggatcaagcgatattgacttgtactgggaagacactaagcattgtggagatatcgaagagtctcagtcgtggatctggagcagagggccacaaggcagttctctttgcccatagagggagaggaacagacacttcttttgtgacttctccatttgcggcagggaatgtgtgtcagcacattgccaggggtgtccctcttacctcctcgcagcagagacaattgggaacttgttttgtgagagcagtgagatggattatatggcctctggctttttgagacaatcaagttgtccttcacactccaagtggatgtaattaactgcactgataggatgttatgccaatagcaacacagaaaacaccggaaaatgagtcgaaaggatgcctagtgagctgcagcagaggcagagaggggaggagtccgtcgagagtgctatgtagcccaccttctcttgtggagctgagagaaaggactttggccccatgactttctaaagcagatatggatttttactagctccaaaaagagaaaaagaatgagggtatgtgccctatggttccctcttggagttgtgggtcatttcagaaggagccatggtcagaaagggggctgccctagaagctgagagctttcgattctagtcccaaggcagtgcgggttgagctgtgcaacctttggaggcccacggcactatactggactgagagtcggccttgtgaaatgaggaggggtcagatggcctcagtgcatctttctgctctaatggtctctggctttacacaatagtcattcacagaaagacagaaagggggaatgtgaagtgaatcaaattgctttcgatggtagaatattagtcattttgtttcccgatgactcataatcagaagtgatatttgtaagcaaattttaccaatgtttactaatggatcataattttaagtaattaaatactagttaattgatttcctgaatattaaatttaactttccagtaatagtcctccattaatggatccgctcttagaagtgtttttaccataataagtcattaagatttcctgaataatttctctccaaatcattgattttaagttactttgccagcacaaatgcataaaatctcataatgttgccatgtatcaatttcaatcaatgcagttatgacaatctgtgatttgtttatgtcttacttttaaataataaaagaaaggacagaaaaaataggagattgtggtaatatgtagaatatttgccaggttgtgtataacattctccaggttgtctctccaggcaactccaactctactaatgcctctcctcaaggattattctaatggtaaattaagattataaatacgaaagcatcaaatagtccctgacatatatttgatatatggtgaaaagttgcctgttaatttgctaagttgttttcaaagtccccatggaagatctggcatggattttatcctacgggaagccactgaaagttctgagcaaagtcaagatgtattaaccagtcattccagcagcagcacatggaatatggagcgatgtgggctgagatgagagtcaaagacaaaaacaaaaagcaaccccagttaggatggtattccaaatagttgatacaagagatgataaatttgagaattgttggtctgcatagtaaaataggattgtgttgaaagctgtcataggggttgtcttggtgatatttttctaatccattttagagttttcctttcatttcatttgtaagtatatagattgcaggtttccaaatgtttatttaactagttgcatgaagtgcttcataaaaaatatgcttttttataataatgacattgatgttagtgttgatgatgaagttaattattaattgtgcttcccgacctcataaccaagaggtggaaaggggtttattgtatcctggtgactcatatattgagttgtatattggtcctaatataacagtttcaaaatcattcaaaactatcttggtcacctattgaatttgcaacgtactatactatataaatatttctgtcacaatattttatcatcacagtttcaagctttatgaaagataaggtcaaaatttcaatattatatctgagagctttgcagtcttagctatttatttgtcttttttttttattggagtcttgaaggactttatttcttttatatgtcagaaagagtccatgttattccatgagttgctgtataggatgctgaagattccaagtgttctaatggtcccagagcttaatacccagaatctcactgatgcgtctcaattagttccaaattttcaagatgattaacctctacttcctccatttcctgtgtcctgaagaggaacaaagggataactcacctgatacttccagctctgtgcattctgaatctaagctcctgtgtgtccctgggtgacagcaaagagtgctccaactcttggaattacctgcctgacaagtctagaaatattagagttctttatatttaaatacacagagctgtaactacaaactttatcatttttggactaaatggagaaaggggcacactttctgtgaagtctttaagtcatatttgcactctttgggtggccttgtgctaaagaggctatggagtgtgaggacagaggagaagggtcccctcagtgcatgtgatgccaaggctcatggtacattgtatgactggagagtcacttggcttgctatctttgctgtcagatggcgctcactggtctctgtgtttgactttctttcgcataacatgtcagtccacttactcttaggagagttcccgagacaatcaggcaaactctcctcgggatgtcttgatgaatgtgtgaaaagccagggcattctgccaagtgtgctttgattaggaggtaatagattccaacttccttctgtcgtgtctctttctgcaccatagaatgattgtttgcagggtcattctgggttcacagaattagtgactcatctactggttatttggcagttcaagaagctaggacatatatctgttgctcaaatgactggtttccagctgttgagatatcaaaattctcttgaaattcttcgcaaagttgaccctgcacattattgatggcggtggttgagagtaagggagaaaatggatattgtttacacgcagacttttgcaaggactggtagaagagaattggggtgaattgtaggatttctggagtcagaagatgagggttgctgttgcagcgttaatatccagatgtatgatcttggaaggttgcttaacgttctcagttttaatctctgcatcttataaattagagatttgtgctaaatgatctccatcattcttttcacccttgcattccaacatctttctagtttcctccaaattacctggggtctttgttcactttctgctattctctggctcctgtcatgcagccacaatggtcctgagggtttgtaagaagattctggatgatagaatatattgcggaaacagcaattgagttgcaactggaaagacttgggctgtctgttaagctccatcatcatgaaaatgagctttatcttctatgtgtgtgcatatatttatatttaaagctagcataaaaattatacccaattcctacttcagggaaatacttgtaagaagaaaccaggtgatgaagggatcatctgtcactcacgtaatgggaggcactgccctctagacatgcttgaggagagtgagagaaggattcagataggaaggaagagagtgacatcatccccaccgcacctgggatgcggttcagggttgtgcgccatttgcatcctccctatgtgaagattttggaatttccaagttttattctgtaatatccctgcattcagctctgcctcttgcggtatgaaattctgagactctcggccgtgtaattaccttcacatctgaaaagtcactgctctgtggagctgcaggtctctgccgttgcttcaggctgctctggggcccggcctgcccctgtgggggcataatggccggcgaatatgtgctgaggccccctacccccagccctgctgtaccactgccagtcccgaggcctgcagactccattcgggaatgcggctgagatttacctttgtcctgcggctgctttaattgcagtgaaacgagcttattgaaagcagtgctcagaggaggagtgccttctgtaccaggatttcacatgcaggaaaggtttctattttcagtaccgactctctcgatggaaatctctttctcccttgctcactccctgtcttctgaataaaaattctccacacagtgatggttaaaaacatcaattaactctaaaacaattattattttttgaaatgccattttataaatgtaataacacgacacaataatccagggttatttaacagagcatttaccctgaaaacagtcattactctttaaatgcaggagattctagaagcctcttaacattaaatggcaagtgaggcagaagcaatattgtcagaaatgccacatccgctgcatatattagcaagaagaggccggtggctgccctgcccactggctgccattttcttggcatttcttgggccccaaagctttctgttcagagtgacatcagccgacactgatgtgacaggctggtagttggaagaaatgccctgtgaagcatttcctcctgtgttgtcaccctccctctccacaacggactgaagcctggtcagttgggaggctcttcttgcaggttctgtttagcaaagtgcagatggcagcggtagaagggctggtgatctcacctggccttgaagctcctattgggttggggtgggctgccatcttccaggaagctgtggcacacagcatgcagaagcattccagcctcacacgtttctcttctgagaaatgcctatgaaatggtctctcagaatgttcgcacaacctgaacaccacttctatttttggacccaaagaacacatccaagtattttgacctacatgaaatttctgttacactcagcccttgaggtctggggttccatctggaattattaacataccattagactggttatttttttttaaagtgtggatgtgtgagaagtggaaaaatgtcccactcagatagacagccctgcaggagactgttcacttgggtggccaagggagacgacctcccaagggctgcagctgaagctgctcctcgctttcagctctgccgtgtgggtggtgggcatcccgcactgatgcttctgtctctgaggcacccttgcccttctgaggaggagcgatggcacagcgacccctgagcgacgctcttccggggtttgccagggcttgaggaacctgtgattctggtgcagggagctgctgtggttgggattcctcaagctggtgcccacagtccactgcaagcctcaatcctgcaggtctgaaggctgagtatccttacctgtgaccaccaaatgtgatgtttagaaagcccaagtagactcctgtctgaggctcctctatcatcacttattaacgtgaaagtgcaaaggcagggccaatttatggcatgtacaaatcaatgcgctatgtctttctaaccaagcagcaccttatctttgtgtttacaataaataagatgaaactgtctggtgagaactggtggcgctgtggtcaatccgggggtggtgaccacactgttgtccaagtctcctagactccttagaccacttagcctgaattgcacaagggagtgcctgtggaagtatctagaaggctagtgggaagacccagggagagggcttggaagcttagacttttcaagtaagcacaaaacttggaattcatatacactaggtttttctgttttggaaaataatgtgtttatagggacccagagaaattgagtgactgctcagagttaaacagctaattaattgtagggggaatctaaatgtgggtcttctgacctcaagtttgtgtgtgtacctatgtgtgcacgtgtgtgcatatatgtgtgtgtgtgagagagagagaccttatgtttctttgggggaggggactaatgtctttcacttttctttctgtaacatcatttgtcatgctcctgtcagtcttcctgttattagtcaggccgtatttgatgggcaggagtttgtgctgttgctgaaagtcctctcgcttgtgctcctgtgttttgttgtctcctagaggtataacatgactattggtcatggtgaccatcaacttctttttagaaatccctgactacaaatgatttcagggagcaaaattaccaaacagctttgggacacaatatgttttggaactcatttagtcaatttttttttcattgactcattctacatctctcagacctaccatgggtcagcagatttgccagctgtgagataactaaggcacattaaaccaggcctccacatgcacagatgtcacagttcagtggggaaggaaaccgtgtaaactactaactcgaccatagcgtgctggtgctgtaacagagcaacgtgcagtgagcatttggagcatcgatgagcaaatggtttattctactggacttagagagcagtcagggtaaaggtcatttgaagggatcatgttgatggagtcacatttacatgaagttgaatttctttttcttttcttcttcttttttttttttttgagacagagtttcgctctgtcaccaggctggagtgcagtggcgtgatctcggctcactgcgacctccatctctcaggttcaagcgattctcctgcctcagtcccctgagtagctgagaatacaagggtgtgccaccatgcccagctaatttttatatttttagtagagatggggtttcaccatgttggccaggatggtctcgatctcttgactttgtgatccaccagcttcggcctcccaaagtgctgggattacaggcatgagccaatttcttgaagcagacaaaggacaaatggaggaggaaaagcattcctggaaaaggtaacagcataaggaaatgcatacaggcatgaacccccatggaaagaccagggaacgtaaaacagcttttaccgttagagtgttagaaggatggattgagaaaatgtggagggttcatattgcaaaaggagctgcggccccctgttgggagtcagtgacgtagatagaaaacaatttttgaagtaaaaatggatggcaattcttacgatatgttagagggctgtgaattgtaagcaggaaaatctggttagtaggagactctgggcagattttcatggtcaggataggggatgattgtcagatccaggaagccagcatatttgccttgtcaggtagagagctgtcgatatttttgttgactaaataaacatggatgtcttttaccatatgcattctgcattttgcttcaatccccactaccctctattacatgaaacccaaccagcctcactctggttgctaaagggatttgggtttcaaccaaggaaacactggtggggatacagaggccagcaacctttgccagcccaaagttgtttataaaagaggcagcctgttcctttctggaaatatctacttccattttcagcttctcctgagtttttccagccccgtaacaagggcagtaccctcttttcctttcctgtacactcgctgacattttcaatggtattaggagaagagtacagtgtgtgttcctcaagggcaaggattaactagctgcttcctgtgaagaaattctgaatggtaaacgaccctaatggaatagtattcatttcccctgttaatatggtgcctacacaatctaaaattaatattaccaaaaagacttgactcccccagcacagagatcccccagaaaaccacacactgagggaggcttttctagaaagggcggttcttagggaagcaagggcccctcagggctgactgttcataggccctaaagataaaacaaaatagctttatttaaagatttatttaagatgttttaaaaattgagtagaacatacatttttaatactgattgatattattgtaaagcattctgatgagaacctgccccatgggtccttgcctgctacacagacagaatattcctttgcatttctacgatgagtcatgttttagccatggattaatgcatcgatgaaaggtgcccccattctagtaggggcagagggaaagagaatgtcgaaaggcagcaaagagaagaaagaagagaaccatggtgtataaaagtcacattttaggctgcatttcaaaaaacccttccaaagtagagaggcttcatgctcacattctgaaacattccttgtagtttagaaaatctgtgcatttgaggagtggttgaagactatgaatgctaagacatgcatcattaattaaattatagttcccatttattgaacattggctatataccaggcaatgacttctgcttttacacatattagtttgtttaattctcaaaacaatggtattattcccattatacagaggcgtagaaacatttgataacttatctaagcttatactggaagaaaatgctggaactaggatttatggaagggcaatttgactcaagggctcactttttttttttatgtgactagattatcctgccactattgggtgttcctaaagtgaaattggtctcttaattttgcatcatgaaggtcaatatgtcccatgtattttcagccttccatctttgggaactatctacctagcatggtggtgaaatttgggctctggagtcagaactgctttccaggctgggtgtggtggctcacgcctgtaatcccagcactttgggaggccgaggcaggtgaatcacctgaggtcaggagtttgagaccatcctggccaacatgatgaaaccctgtctctaccaaaaatacaaaaaattagccggacgtggtggcaggtgcctgtaatcccagctactctggaggctgaggcatgagaattgcttgaatctgggaggcggagattgcagtgagccaagatcatgccactgcactccagcctgggaaacaagagtgaaactctgtcaaaaaaaaaaaaaaaaaaaaaaaaagaactgctttctagtcccagctctgtcccttgatctgtgagatagacactgggcaagttctataacacagctgagcctcattaattataaaatgggtatgtaattgtcagtacctccacagtagtgttgtgtaaactgaaggagatggtccatttggacttcttagtgtttagcactacggtgaaataaatgcatgtccaagaagtagctgaagttcttaagggatcccagtgtcactgagcatgtacactgggttctgaatgcaactgcaactctgtggggtctctgaaacatttcgttttattgttgaacattgaggcaagctcagtcttagttttaggtccagagaaaaatcccaattcaaacaaactcacgacctctgaagcagtttcattaggcaggtttttccacacacagctctaattaccaccactcagactgcccagggtgcgggctgctaactaggtcaggatctgaggagcctggccagcagcctcttgggtgtctcctcttaagtgcacggccatctgcaggcttctgcgatatttcttgcttttgaatttatagaaccattagcctggaatctaaacaaaacacctagtcttaatagcttagtcagtaggtggttcaccaacaatttcaaaaactagaagcaatagtcagttcccagaggagtagcagttgttgtttggaaacaattctccaaattgcatttatttcacagcagtctgaggtcacaaattcaagagcaatgagaactctattcaattagacaactcgatcagaatagatctgtcaagatgacattccatctaaatcaattgagatggagaaataatttagctgctgctgttgttatttagatttttttattatgattttacaatttgttggagtgaggaagttgggcatggatgagtgctgggcagctcctggcatctgttgctctattagatagaaatgcattctcctctgtgtgttgtttgtgctgtattaatggccaaataggtgaaaagtgtttcctgaatcagtagattgacaaccaataagctcaaaaaagggtgtccaagattttttccagctgagtgtgagtccatctcttctcctctccccttttcccccacactttaggaccaatctttgtttgccagcccatggcaaaactttcaagactcaccaggcatcattgatccagtcacctagaattatatattgacattcaggggttataagataatatgtttccttgaagccatatagctgatttctgatttcagatagagaatgccatctatcaaagacaaatctttgaactacaatttaacgccaatttcgtcaaccattaccaatgaaaactacacacacgtgcacatgcaaacactcatttttttccccttaaataacagagggagaaggtagaatagcagtgaggggaaaggttagtgaggagcattcccaacggtgtttcctgctttgttgttctagggttccactattttaactttggctgggagagtgatgatggactgaccccttctttctctcttatttttttatttgtgtatttatttttctatttatttacttatttttatagagataaggtctcactatgttgcccaggctggttgtgaactcctgagctgggcctgaattccaaaagggaggagggtataatgaggcatgtccaacgcccaattcccatcatagcctgaactattagtagtttttcaggttaactttggaatggccttgaatgagagaagggttccattcagaaagttggggagcttagaattttatttttggtttacaacagtaatgtctggcttctcagggaatttgataaataagagagaaatagtaactcctcagtgtagttatagatctcagccatgtctagtttatggcataaatattataaaacaacctcctgtccttggtcacatatgggaaacctttagcctgtgagggtggaggaaaagcttcccttctgccctctttgtagctttgtggaaatgactgattatagacagattaataggaaaaaaatgccataacaaatttatcaacaggctatggacacagaagtcccataatatgagactcaaagaagggccagatagttgaggcttaaatgaaagagaggtaaatgggggatgtagacaagtatgaggggtaggaaatggttttcaggggaaatgaatgagcccaagaaacaattgcctagagcaaagttcctctgggctctgggggaggtggtgcaaaggtgagggcagaacttcactgcaaacaaaggttgtcttattatgcagataaagtctcccaggtaatttctcggagttgcctttatgagaatagatgaaaagtctatctgggtgtggtgacaacttttagtctccttgattctttcctggttatttgatgagattcctagggagcaagtcttgagaccactgtttttcttgtggaaagaagtttccttaatcagataaggaaattcaagagagagcccctccctgtgccaggggtgagggcagaagaggtcagaaagtcctgattatgaggctgcttctaaagtcttcttgttaaagcatgcagaagcaccagacttctgggttgtcattttctgagccccaacaagcccagtaaaatatctgaatttccttctgaattcttgtttttcttctcccccatccctgatgagatcgtcagcatagttttctggcctgagtcctttggttggggcaatgtgcactgcaggccgctcaacagccaagtcacagaaatcacacccgtgcacacccagcatgtgccagacactatgctgagcacgtcacacagggtgtcttactcacagaagccctcaggaagttttttattttcacttcctccaagctaattgcactattaactgtgctcattcccaagagccctgactacttgagccccatccccatcgggctaacaacttcttgtgtgaattcagcaccctacagccattcagcctcagtttgcaatgaagaaagttggggttcctcaggaaagctccaaccagctataatccataaattcctggaccccgagcttgatttattgaccatttcctctgatctggcctcccactggacggtttttcatcagaaattaacattagaagtatcttcatttacataagccatacatacatttaccttatgctggagtaaaaaggaattacataatgccccatgacgcaaacaccggtggtggggggagttcatcatcctgttggtggttcttattccaaaaggattcagtagaggatttctttaagtaccaagattcccttgtgaattccaagtacaattcagtttacatatatttttaaggaagacatctgtcacgtgtaaatcaagatgcatttgagtaatctacttggcatgcctgaaaactgtcatttctttttcctttatgcctctttatcttttctctttcactactactgatgattctactgctgtcgcagagaaatatagagaggcaaggtgaaaagctgaggacgcaccgtgcccatctcggagaagcacggtgcctggggaaaatggagtggccagtgtgacatgttagtggggaacctgcaccccaaatttgttgcccttattttgagccatagctaattgtacatcacatcctgcctccatgtcatcgtctgtgtatattttgcagagaaataaaggaagcaaaccgtgattgagagtctgttacatgacaagtgcaacgctgggctattcatctgatctttagaagaactttgtgaaacagttattttcccattgcacgctttagaaaactgaggactcaatcaattatttattcagtttaaaaggacactgtgttgttcattggtgatttattatggtgagattttaattatttagctggtgtttatttagcttgtcctggatgtgaggcactatactgcacactgagcctatgataaggagcaaacactggagatagactttatttatttattatttattatttatttatttattttttgagagacagagtcttgctgtgtcacccaggctggagtgcagtggcatgatggtggctccctgtaacctccgcctcccgggttcaagtgattctcctgcctcagcttcccaagtagctggggctacaggtgtgcaccaccttgcccagctaatttttgtatttttagtagagatggggtttcactatatgttggccaggctggtctcgaactcctgcctgccttggcatcccaaagtgctgagattacaggcatgagtcactgcacccggccccggagatagactttaaataataacacaaactgaagtgagatggcaagggcgctagtggattgaatggagagccacctagaactgcctgttgccaatttgagaggaagatttggactagttaaaaatgccagagcaggcttctctgactgtagacatgaaggagctggagttagtttggctagggagggtttcatagagaaggaacagaatgtgcagagcccatagggcaggaaggagaaaagcaagccaatggagctggaggtcacagcgtgcggagacagtgccaagtctgtaaggcacatttaggagcttcatttctattaaaacaatagaagatatgagtgaggctgggctgaggggagaatgatgacatgaaaaatgttttgtttgtttgtttaaagataattttggctgcaatgggaagaaatgcgtatcagtgggcctgagtgcacctggagaccctttgggatgcaaggcgagagttgagatgagagatgatggtggtttaggctacagtgatgggtggaaatggagaaacacacacagatttgaaagacccttaatcattgagacttggtgatagactgcatatcagaggaagaaaagagtgatatcaaggatgacaccccattttttgactggcctaattgaatggctggtggaacattcatcgaaatagaaagtacagaaataagaccccattatgagcctataataagtccattatgaacttgctgtgggcatggctacttggaattgctttgcagttaagagctgataaaaagaatgcaagttgtacaggtctgtattactcagggttctctagagacataaaaatcaatgggaggagatttattaagggaattggctcacctgattatggaatctgagaagtcccgtgacagccgtctacatatgggggaccctggaatgccagtagtgttgctcagtccaagttccagggcctgagatcctggggtgggagtgggggttgctgggctaagtcctagaatccacaggcgagagagcctggagttctgctgaccaagggcaggagaagagtgtatccgagctccaggaaagaaacctatttgccttgcctcttttttgttctgtctaggtcccagcctatgggatggtgcccacatacagtgagggcagatcttccccaccgagtccacttagactcacatgccagtctcctctggaaatcccctacagacacaccccaaaataatgctttatcaattctctaggtattccttaatccagtcaaattgacacctaaagttaatcatcacaggtccacctttgtcaacttggcacctgtttgcatcccattaaaccatacttaacctccaaatgaagacagtaacaaggaaatagttccacctaacgtggtgaaactatctgcatacaactgaaaatgcactaatctcttccctagaagagaaggtaaagtgtttggatgataactgaaacactatgatgtaaaattaacaacacatatatactgatataaagtcaaaaaatcttattatacataataaagggataagagatgagcaaaaccaaagatatttgcttaacatatttataacatgtatataatatgtacaccaaaacatatccttaacaagataggaagaaaatactcatgacaattactgtccttgtttctgtaactagtcacatggccacagctggtatttataactgccttccactacccattctgtattattttacctgcagcaagcacctcagctggtcatggttcattacctggtggggtgacctgaacctttattcctgaggaatctgggtcattagtagtcctccctggattgggttgtggtagtttcccattgaccttgatcatggggcatggtaatactaagagacaccctaagggatctcctgtattccaggcatagtcttccttacatccagtggagtagtaatccagtttccccttcctgatccggatcagtcacccagtcagcaccataacatagccagttgactcagaagcatgaggcctccaaagtggctgcgggggtggggggggcagtctaaacttccagttcaatggaatcattgttgtgtctcctgatggaaacattactctctctggaactaagacctctaggtcagcagagcataaaatcatgggaaaaggaagcaaaacctttgctagtgggtcactaggggtattggtgagtggtgacactcccactctgtgattcctgactccatgtatcctgactatgggaaaaacaggatcatatattggatgctgattcagagcacatacagccttctggaaaaccttgccccagtcctgcaacgttagctggtgctgtaactgcaacttcaaaaggccattttattgttctgtcaagcttgttgcttcagaatggtgggacgcatggtaagattagtggatcccatgaacttgggcccagtgctgtacttctttggctgtcaggtgagttccttagtagatacactgtgtgaaataccatgagcgtggataaggcattttgtgagtccacagatggtagtattggcagaagcattgcatggagggaaggcaaacccatgtccagaggaaatgtctattccagaaaggacaaaatgctgcctcttccatgatggaagccatccaatgtaatcaacttgccaccacgtagctggctgattgccctggggaatgatgtcatgtcagggtttcagcgttggtctctgcaacaggccaactgagcactcagtggtggttgtagctagcttagccttggtgagtagaagccatgctgctgaacccgtgcacaacctccatccctaccaccatagccactttgttcctgagcccactgggcaatgacagggatgactgggaaaagagattgactggtattcacagaatgggtcatcctaccctcctgaatattaacatactcctctgtggagctcatctttgggtgagcatttacatgagaaacaaataacttcacatcctttgccgactcagagagatctatccacatatctattctctcaatgtttttgccaccaattttctaatcatgttcctttcaagtccctgaccatccagcctgtgaatcagtacctaatcacacatctggccatttttcctctaagcaaagtgcacaaccaggtgcactgccccaaattctgccgcttgagattttcctttaccactgtcattaaaggatcttccagaaaggggctgaggtgctgcagctgtccacttttagctggtgcctctgtatcatacagaaccatttgtccacaaagcccgatttttctcttcctctgtcggctgatcatgaggactccccataaggccataggtgcaggtggtgggagagaaggcagtgtgataggagtagacaccaaggacatttggggcatttcttcatgtaacttctttgtacctccagggcctgtgctggtccattatttgatgagggactgctgctgtgcatgcccttcctggcttggtaggtcagatgacacccagttcatgatgggcagctccggtcacctggtaattggtggcccatggtcaagcgttcagtttctattaaggcccagtagctggccaagagctctctcaaaagagtagttatctacagatgatggcagagccttgctccaaaatcctaagaacttctgctgtgattcttctacagcaccctgccaaaagctccaaacagcatcgctatctgccactgacatcttggatatcattggatctgctgggtcatatggcccaagaggaagagcagcttgcatggcagctgggacttgctgtagagccttctgttctggactccactcaaaactagcaatcttttgggaccctcaacaaatgggccagagtaagacacccaagtgaggaatgtgttgcctgcaaaattcaaataggcccactaggcatggtatctctttcttggttgtaggacgagccagatacacaacatatccttcatcttagaaggaatatcttgacatgccccacaccattggactcttagaaatttcaccaaggtaaaaggcacttgaattttaattggattatctcccgtgctctgatatgcaaacgccttacccataagtccacagtagtttctacttcttggtcatgaggtctgatcagcataaggttatcaatagaacagtatgaaatcttatggaagggaaaggcagtgaagattcccgcaaactggattgtgacataaagctggcgagttgatatatctctgatgtaagacagtgagggtgtattgctggccttgccagctgaaggcagagtgcctcaggtgggccttatgaacacaaatggagaaaaaggtatttgccagtttagtaggtgcataccaggtaccattttgaaaactgcattcaacttgtctttgacggttgagtgccgtcacttggtccctatcaccttgggatccaattactcccattgcatttaagttttccaactgaataacagcagctcccattgtaaggtctggtctacagagaagagcaatcacagagctcttcaggggtgctggggctcccctcacaaatccattgttcaaagtattgatgaaaagtctgtcttctggaccctcctggtgtgtccgagtagggtttaagtgacaaatccactgtagctttccaatctccctaagcctttgaatcccttcctctgtgttagcccaagggagatcaggcatctccagctcactcacagtggctcatgttttttgatccatgttttaccactcaatcaaacaaactcactccctgagctgcaaagttaaattgaggacctcggctctgagggtccatataagtaaatttggcctgatccaactttatatttcttccaccatattcccacactctcagtatgcattcccacaagcattccccagacttctgcttgtataaattagaaaactgaagtagttcttttggaacatggcacacctcctcctgaatcacactttgaacctcacctctaggggcctgctgggactcaagtctagttacaggtccagaagcaaagaggggcagggggggtggattctgaggagactcagcattgtcttgcttggcaactgcctcatggaggctgttaccattttcttagacaatgcagggttaactccttcagacagagatggaaaaccctatactattgtgggtgggaaccacttctgctagcaaataacactcatcagaatttcatagctcagtgtctccagcctcatcagagccctcccacacatccccatctcaacttacagatcccattctgtctcaaccaatggcctcactttaaccacagacgcctgcggagctgagagttcagcttttgctgtgattcagtcagtcatatgataagcgctcttgtttgattttcagcaatcccagacctgtggctacatgggaggagattcagactcagggcacacttagaagctcttcagctatttatgtagagctggggcaggaaatggaatacctgaactcattcttttccttcatccctttgtccactgacattaggagcaaccaaccaaagtcattatattcgttggttctgcacaaatgttaagggtatcatatatagaagtcaccaagtttcttgtctcttataagtggtgaattaaaagtaccaaatgtacctattttatgtatctctatgagcagtttgcactagagagttcagtgctctctgtgctgttagaagtagagtctttggcatttttagatttaaccagattagatagccaattctagaaaccccaaaccaattatgaaaacctctagaaccactgttggtactaaaatctgcactagtcagtgttcttcagaaagacagaaccaacaagctatttatagatatatagatatatgtgaggggatttattaggggaattgactcacctgattactgaggctgagaagtcctgtgacagccatctacatgctggggatcctggaatgccagtagtgttgttcaggccaagttccagggcctgaaaacctggggtaggagtgggggttgctggtgtaagtcctagagtccaaaggccagcgagcctggagttctgctgaccaagggcaggataagagtgtatccaagctccaggaaagaaacctatttgccttgcctgttttgttctgtctgggcccccagcctatgagatggtgccaagcacactgagggtggatcttctccacttggtctactcagactcacatgccaatctcctctggaaactcccttacagacacatcccactataatgctttccagttctgtaggtactccttaatccagtaggtggatacgtaaaattaaccatcacaagttctgctgctcagaagagctctaggctcttaagtggtgtgggcccctgaagtcatgggtgtggattagctctatggaggataaagaagaaattaagaagacagtgccttagacagagtcttggagatctttaatacttagtagctttagcttggatgaatgaaacataagaatcagccagaaagttagctggagagcaaggttgtttttaaatataagaagctcaagaatactatttcaagaaggaggaaatagtccaaagaaccaagtgcttgcttgtaagtcaggtataatgactgataaaagacctagtgtaacaagatgattgatgacattaatgaaaagtatttcaggcaaggatgagaccagacttaaatgagtagactgaggactgaatgggaggtagaaaagtagaggcaaacattataattcttacaagaaatctggttatttagagaagaaaagactagaagcatgatggaaggaacaagagtagtggagtaaattgtggtgtggcatgtgcttgtgtgtgtgtgtgatgtaaagacgcatctttagcttctagaagttttcaatttaatgtagacaaccagaccaagaaacaagtatgcagcactttgataagagtgtgtaaagacagcctataactccaccttgcttattggaagccaggagacgagatacagcccaccatctttggaaactgtggtttaatatgaaattctttctatattttgactgaagcttcaaaacaatgggagctattaccatattgcaaagcaaggtgccagaccactggcaatacttgcaaagagttgctaaaacagattttgcgatattgctatctcctcacctttagccttcataagaggctggcaaagagagagtttgatattagaaagacattagtggcttctttctcagagagctcctgatggtctccgaattgcacccttcccagggaaggtgttgtggaacagacttttttctcacctctagactagatggaggaactaactacaaggagactacacacagagcttgatgatcccagggaaccaaacaaaagcacaggtgatgggctagctgagtgcccagcagcagcaaatagggctgcaccggggtggggcaggggcggtaactgcacttctcacagccatggtcaagcgtctgtatttcccgaggatgatggcttagccatgctggaaagattaggcctggaggttttttgttttgttttgttttgagacggagtcttgctctatcccccaggctggagtgcagcggcacgatcttggctcactgcaaccataggcctggagtttttatagctcctgtccaagtgaaccaccaaatggttcagttctgtgacaacgaagggtctaaaacacccactgtagttagtcaagatgattgacgatttcaaaaacaagggttaatgggggtagaaggttgatggcagaggggtgaaatgtgagtgagaaggaaggaattataaacagtgagtggggacaacctttgtataatagaagttgtgagaaggagagtagtacatgaaaatagctataggaagggcctttgttttgttttgcttttcaaggatgccaaaatctgaatgtaatccagataaagctgggctttgttgcttttagcttcttgctctttgttatattctactcaataaatagcagtattgcaacaacagtcacacatattattggaaagaatactttacttttgagatggagtcttgctcttgtcgcccaggctggagtgcaacggcatgatcttggctcaccgcaccctctgcctcccaggttcaagcaattctcttgcctcagcctcccgagtagctgggattagaggcacccaccaccaggcccagctaatttttgtatttttagtagagacggggttttgccatgttggccaggctagcctcaaactcctgacctcatgatccacccgcctcggcctcccaaaatgctaggattacaggcgtgagccaccatgcccggccaagaatactttacttttgaaagcgagaaagggcctctctctttgtaatgcacatcgatgtagttaaaattattttttctctatatttctttccatattttacaagcccttcttctgtcccccactccaaatagctctccttttcttctcaaccaccccacactctcttctaaacccagttagaatgagttattgattcttctgtctcctggatatgcctttaggatctattctaattttctaggggagaagtctgccttttccgctgtaaatttagtgatttccagcctctccagctctccagcctcattgctactcaacacagttacagacctttctaggtgatgacattggaacaaaggctcttgtcttttaaaagcgatggaggagaagtccttaagtattcatactttaatattgtagctttgcatcgacttagtattcttcaacactgttggaaaagagccagagggagtggagctggaaatccatgcagtgggtccttgaggagagaagcaagggtgggaacggagcccaggtataggggaaccctcagacaggagggtacacaattcacggcagcaggggtgtgggtgggagaggatgggcgggatgaagagaggatgtttacagggaacatggaaattgaaaaatctggacgttaagagaatttctttcatgcagctgatttacccagctaatataaggtaaagacaatatttgaatgaaattagaggtgacaagatattatccaaaatatttatacattcattcatttgttcattaattcagcaaactttcaatgagcacttgctctgtgccaggccatgttctagacactggaggcctaagagagaacaagagagataaaagccttgctctcatggcgttgatattctagtttatattctggtttatataaactggaatatacacttatatattccaaatatatatttatatcttccagttcatatctagtttatttgcatataagcaaactgaattttaaatattccagtttatattctaatttgtttatttgcacataaacaaactcagttttaaatattggtaagtattttaagaaaaataatacggagtcctgggcaagaaaggttgaaaagggaggaaaatggctacttttgctatgatgtctcaaaaaatctttctgaccagatggatgagcttgggtctggtaggagaggaacagcaacaattgctgtgtgcccaagatgtaaaaatagttatcagtgaagttgacacttgaaccaagacagccagacacttttgggaaacttacctaaaataatttttgtaatatagacttccaaaaaagttaccaacaatcacctagaactaccttacctaattttaaaaaagttctaaattacatatgctgatttctcttaaggtaaataactttggatgtggcttgtaaattgcatactactaccatgtgggacggacacaaacaaggtaagatgatgttggcatacttcataatagagaggggagatgtaaagagtgttagtgctttgctgagctcatcaagctctgactttgtttcttgtatttctcatcatagggtcatttttcttttctttttttttctttttttttttttttttgagatggagtctcgctctgtcacccaagctggagtgcagtggctcgatctcggctcactgcaagctctgcttcccggggtcacgccattcttctgcctcagcctcctgagtagctgggactacaggcgcccaccaccacgcctggctaatttttttgtatttttttttttttttagtagagacagggtttcaccatattagccaggatggtctcgatctcctgacctcgtgatccgcctgcctcggcctcccaaagtgctgggattacaggcatgagccaccgtgcctggcccatttttctttcttatctttattttatcttgctcttttgtatgtatctttgtaacctcccttaaattattctgtgtaaaagttgcatgtctaaataaagagcatactctagaaactcagtgatttttctcttctgcttcttcacttctccggtctccaaatgctgatgtggatgtctgcatctatcttgttgaagtaaaattaaagaacaatggatttttcatatgttggctcttttgtaacttgactcccccagaagctgagcagtgagatttggagggtgaagaaagatattgtcagtgaagatggttctagcattataggacttctttgaagtggaagagaaggtattttagccaacactcagaagcttccaagaacacccttgacatcagaattccctgaaaataggcatctcaggagcattaaagaaaaatttaggttataaaaggaagaaggcatagcaagtagaaaaaaattacaaaggccccacaaagataaaaagttgccttgcggatgatgatggaagcttcatccagaatctctttcctaaaatatgaaattagtttaggttttgccactctcaaattaaaaatactaatagcccatttctgcctattaaaatggtgcatattgaacggtgtctatgcttgtgttacacacacaataaattaaactttgacgtatttctgcaatttctgttcactttttcattcgggaagcaagcatttattgacatctcctatatgccagcactgtgttagaatggaatgggctgtatttattcagacaaacctcatccctgtactaattgaagtgtgatatcctaatgagttcttctacaatgctgctacctttcttagatccagaacaaaagtaaaccatggagttggaagacaaaatactgatgacaaaatgtattaattgtaattaggccctgggcactggctgtaagagggagacatctctggtaggaaatatcaggaaggaaaacctaatagttctgcccagttggccttcattatcaatcacttggacctttcagtgagtatgtttttctaatgagatgagagatgcttgtaaatattccaagatcttcagctacaacatgactatgtgggtggggcattgttatcattgtggatgcaaatttagaatcttttctaggcaaaggttctccactccatgaggtcagaagtacctgcttgctaagctccagaaggttatgtcccatggacatttgaacagaaagcaactttgtagcacttgcccgtgcttggtaggaggatgtaaggggtgttttaacgtaagaacagaaggagccaccattattccgacttcctcccttgcccagaattaactagagttaccttaagcaaatcagctttctttgtctgtccttgagatctctttaaaatatcacttaaagttgcagtcctgaggcaaacagttagatgttctctatacattgcccaaaagccaccttctttcattcctacagtgtcattctctcactgtacctggacataagtcctgaaaaatcatctgccaagtgccctgtaaactgtggcactgctctcagataaagaagtaaatggcatgatttctaagagtttagggctgatttgtccttttcatctattctgacatgatttaatgttccagaacttgtaaagggaacagattttttttttcttttttttttttgttgtaaaatttgtgaataatttatcaagtgactgaaagagcagtggctttaaattattaaaatgcattttggttttgaaagaagacattagagatgtttgccttggcccattcttatgcctttacacagcagcaagagattcctacaaattcagggaatggtaaggtgattttcagtgatttatggggagactgagaaagagccaaaaaaaagccaaacaaacaaacgaacaatacagacaactttcatttatttaagacagagctttttccgaagcaaataaccttttgttacatctccagagaaatgacatttcctttcccttttcctgctttgcaaggacagcagatgcgtggggggagaaactgaaacaaatggaaagtaaggcaggcacaggctccttcacgttccttctccatgagcatccctcaccgagcatgctgaaggcatggctgtgcttccttcaatttgtcacacatcagagacagcgcacagcctctgatctctagaggaagttatccattccactctgtctgacctaaataataaattctaggccgtgcagcctggaatgattcctgtctgtcccaaaggaccctggttgggcccatgtgccttgtggtatggggtgagacgtcccacccagatcttggccatcttagtgacagaaagggaactgaacgtcaaaccaggctgtctacatccagatacatcagctcctacaccctgcttttccttgtgcctcccctcttctctttattcccccttcactctttgccagtaatttctcttccacactctcatccaaaggccgcatgcccctccaagcctctcccaaatcctactgtaaatggaaaaggacattccatgctggtcttacaagcaacaaaatctagacagtcatgagaccagcccttggcctggcctcaactttccctatgctatgtataaatccctgagagaaattctctctgggataggaaatatatttcacatggcacagcttaggcagagtaagatagaaagctaagcgtagtagaagatctggcagaggtgccgcagcgcggacagggagctgtgaatctgccgatcccttatgtttttgacactctcttaaaccatttctgattacatcaatcctacctgtttctctcatatttcaatcccttgctctgaaaaggaagcaaaaagtgatcgttctataaaatgaaattttagtacccctattttcttgtttagatactcccaaatgggtatcatcatcctcattcctaagtttagaaacgtgcctattgtactaggtggccgggctggagtcacactcaggctgtgcgatgttgttcattgtactcggtcaggccccatcttcggggtgagtgcaaaatagcttgggaaactgggtatgcattcaatccattttatttcttgttcctccttttcagaacaaggagttggaagatgaaacacagtcatgtgctgcttgacaccaggacacattctgagaaatgcttcattaggcggtgtggttgtgtgtgaacaccacagagtgtagttatacaaacctagatggcatagcctaccacacacctaggctccgtggtggagccgactgctcctaggctagtgttactgtactgagtgctggaggcagctgtaatacagtggtatttgtgtatctaaacatagatgaggtaaaaatatggtattatggtcctacgagaccaccattgtatttgtggtctgtcagtaacttaaatgttgttatatggtgcatgactatacaggtagggtcttagaatgataaaattctgtaagtgagcagaggcttgtacctaatttagtttaatctactctttttaatgataaaactggggctctgagatgctcagtggcttgaatccaatgtgctctccatggggctagtgctctttccactgtagtgagccactggcattctgcgagcggggcacgatggcgttctgggatgtatatgcaagaagtcaggaaacactcaaggtcagaggacagaggcaggggcactggcttttaaaacagttgtggcaattttcatttccaaagatgctgcagggacatctcatctcatacactcttcggtcttctaccagctggccacgactcccccagcacagggaggagtctgggcccccttttcctgaacccggtatggactcatgacttgctcataaccaatggaatgtggcagaagtgactctgcctgactcaggctgggtcagaaaaggccaggcagctttggcctagctggattgggcaggccctggaggagccacctgcctgaaaactcggattacccagagaccacatgctggagaggcccccagctggagctggtccttctcacggtcgctgccaaggtgtcagataaggaatgaagaagccattgtgcacactgcaagccctgtcattcccagtcatttgagacttcccagctgaggccccaggcatcatagaacaggggcaagccgcccccacccaggccaaattccacacccacagagtccatgcccacagtagcatggttgttgttcaagttcctaaggttcatgaggcttgttatttaacgactgataattagagaatagtaaatgtttataataaaaaataaaatagaaataataaatgcttacaaataacaaaaatagttttatagtaagttaattttgaaagctttattgatatgggactagttatgtaaattacgctaatccatacaatggaatactttgtagcccttataggaatgtgatagccctatacttattatggaaagagggtaaagaggcatgacaattgaaaaaagctagtggaaaagtatgtatattataatggtgtttgtataatgaaggcaaaggaaattgtgtgtttgtgtgtgtgtgtttctgtctcgtgggacatgtatctacacaagacatttctgaaaggatacaggagaaacgatgaagtggttaactggatagggggaatgaggactcagggaggggaaatgttacatgccaagagaaatttatttttcttgttactgttttccctactgtttgattttctaccacgagtttgctctattttgaaattaatgcttccaagatgatgaatattttatatgctacctccaaagagaaaaaaattctttattgcaggtgacagctgaagttgtatattttcaactgtagcacaaagacagtaaaaattatttttttaatatttgagaaagcccttttaccccaaataccaacttcattttctgcatagctcagtccaaggtgtcattcacaaaatattaataatataaactatgatgtcatgtgaagtaggtgatattattggggaattaattgatgtcatgtgaagtaggtgatattattggggaatgaatcgtgttttctttctgtgtctcttgacctccagctaaagtaggataaacagcatgtttaaccacgggcagaaattaactcagtcacccaaagagaatggtgattggcaagatgtggttttagatgactgaacacttgaacatgctagctcctttctagtaaggacccatattgtgttttgcagcccatagagatgcagagcttatcagttccccggattttagacattgctagcaagtggcatccaccattctgttctgcagagaatgacacagtccatttaagaagaggtcttatgccatgtcttatatgaagatacctggcatttggtggtggggtgcattcgtggctcattggtaagttaattgttatggtggaagagggagtggaggagaaggcacagcgtgtggtccaggtagatgctgtccactgcacatgatcaatgtcagccagagagctgcacagcttggactcggctctaattcctctccttccactgatattcaatcaggtgcacctctatgtaactaaggcttttatttttggcaacggtctcctatgggaaaccatagttttttaaatgatgtgtcacaaatctgagcaatcacttttcagttctgtgaaatagcttctttgagtataaccacctatatattttagtaaaaccaatttggtaatgttcctaacttactgttattattatttgtgtggcacctatcagagacccttgattgtagccactaatgaaagcttgcacaaagctataaagattgttctgaattataatagctgtcaacagttttcatctcagtaaaccaaaagcctatgctattttgtaacttgtgatgttctgtctttaaactatagcagactataaccaagctatatattcacagaattcccactttatatgtctcctcatgagtcctgttttattttctaagatctagtcaaataaagaaaccccaagcaatctttctgacccctggtatttgtctccttatattattttcctgatttctttgacaggttctctctacggcaaccaacacacttctatccaccacagacagttgcctcattttctctgacttattggagccatttaacatttttgatacctgctcctcaatctgccttctggatgtgggaggcacctcactgtctcttccccttttcaggaagcccctgtcctgtcctattagtaatctcttttcttctccccaccccagaaaggtgggcacacccaaaggacaatcgttaaccttctactgcatattttctctcatatggtgacttcattcattttctaatatgtgaatttttcccaaatggataaccccagctataatctcattttagaattttggctctacgattagatgatttttaagatgccttccagctctataaatctatgatcctattatgtctgactgctcactagatatttcttcttgaatgttccaccatcatctcaaactcaccgtgtctaagtccaaacacattatgtttctcactggaacatgtgaggcatattgaatagagcttaaacagaaactgaagtgcagtagatccaggactcagttttgcctctccagttcactacccctgggctcttgggcaatttgcgaaatctccctgatttgtgattttttagtgtagaagaataatttttattttatagggtttttataaggattgatgagctaaatataaacttgataggtaaatactagaaatacagttgacacataataatgttattccctgtcccatcgcctctcatcttcctgctttccctgtccttttcattctcctatttacccagtctcaaaacgctaacagtattcctgtatgtcatcctaacctaaataaaatcatgtttcataagacagtcttccaaatgccttgaatacctgtgctttatttttattcccactggaaccaacctcactgagctgttcctctcttcacacctggaatatggtaattttgcagctctctaacagccttctacaatagccttcttgtctgcaggactaattaatcctgtgctctcttgcgggtgtgttcctaattcacctgtctgtgttttctataaagaatcactaaatggtgcctgacctaaaataatgatttaatgtgattgtttcagcccccttttttttttttaaagtaggcatacatgacccccagcatgcgtacagtattttcttaggcaccttggtctctattttactgctgccttctcatggctgagttaatccagtagattcacgtgttgcatgaggcgtataagatccagtgccatgcatctgtttgtgcaggttcttccttccgggagtaccttgcccctcagatcggaccattttggtgttcgcgggaaagcctcactgcctccatgaattctttttcaactgtcgcagctgaagcatctttctctttattttcataaacacattgtatatttttggacttattcattgggcattcaaattcatgaatgcaagtgcttttatacacataattcccacttcctagaaagtcttttccccacctcttgatcttcagagttttttactcttccaatttaagcaggataaaatattttctcctcttggaaacctcttatggcctatgcaatcttacatttctactgcttctcaagcagatgtaagcatttggttttctgtgcattcatcacatttttcacacacctctcttatgttacttgttatattgtaatcactctctcagtcagttttccatgtggcttcctagcaagctgggtttctagttcttgttcatcttgataccttcaaccttgctaacacatagagagtgcttcataaatatacgtcccgtgagataaaggggtgaagttgggggatttgtgaggccctatcacgatatgcaaaacatatcaatgagtgattccagtgactccagaatgacctataaatctcaataagagaggatgggacacaaatgacggactggagaacaatgacgaccttcccctggatgcttgctatcttccttcctggttctagaaccactcaccatctacaaacctgtttattcccagcatgataggaagttttatgttgcagaaagatgatgtactggatttgattttgtaatactttttgttttgtttaaaagtcgtttgccttctgttaacttattaaaatatccacgaggttcattttttgtttacacttggatcaagttggcattttaaatttacttgttagaacagaaaatgtacaactctatttctggatatcattggttgtttctttttcttaccctccccctcctctgtagttaaggatttaccttgaaatgtccccagcctgaacaccaaatgacttctgtcctagaagggaataagccagaaggagaaggaaaaagttgggttaagtctccttagcccctaaccacagggctagaatgcaatggcagtgaaatgtactaatttatcttatttgacataattagagttaggggctattgaacacagaatgcaaatgtatgctaaatatgcaaatcaaccacatttcccagatctggagaagggggaaatgtggtagccttatgttagatggttctctcttatctgtgaacacaacttttcagcactacaaatgcaagcaactgcgcagtcacagttggggctgctaatttggaaatccagtttaggctgatttgaaaagacaacagcgtttttgcaatcactggtgtatcctttatgagagagctagtcatgccattttttgttttctgaagacggcctttttttcttttttattattattatttttttaaatttgggatcttgcctaattctttagtacaaagcctggccctaaaaccgtagagtagacatttactgggagtgtccccagcctaaccatgtatcagagaggcctccttgactggatccttgcccaactgcagggagcctagtcagcaggcctcctgccagcctcacagctcctcagctcctcctgagggtccttcagctgcagtggggctgcattgtttgtgcttcatgccccttcttggggggcctgcaatcctggaggctcatgcttcctccctcttcccttcccaggtgtggcgctccaataagtatctggaaccccagactccaattcagcatctgcttctggaaactgaatttgtgatacagatcttcattccctcacccagtgttttccccattttaggaaattttctttgtagttggagatctcatcctctcctaaatatccctgttaagtggatccagtaaattacttcccagtgcttcatcccaactaaagaataaatggtggcatttggggcacccagagtgctgtgggcaacttgtctgagaccctttcaaactatgtcatgtgagtgaccacagagtcgtaaggtcagacttgtaaaaacactattttttgctgtgtgttccactatgctattagtctggccaaaagaggcaaggggctgggaatggaagtgggggtggggagtgttgtcttcaggttaaagcaatatcaaactccagtcagagacacgggaagaaatatggagaccctgcgtggggatcagtttcaaattactatctggactcagtcaaggaaattatgtacaattacttgaaattggtatgcaacgtcattttaaggagtagaataatatggccattctaccagtaatttggttagtaatttggtagtaatctctagtaattactgtaagtgctaaccagttcattttccaaatcacttttccttttgggcgttcactttattttgtacgttttaattgagtttttttgtaaaatggcctaacaatgttttacattccatggccttagccagggctgagcatgagaatccgcaagccactgggcccagttttgttttcagcatctggatagttgctgcttaattcatatgaatcctcatgtgtttccattactgtcagcatcaactaagacatttttgagccctgagtatctttgtggtattataataggggaaaataaaatactgaattaatcaaaagataaggcccgtggagtttgtgacccagaagagatataggcacagacagagtggagcaattctgatgataggttgtagatggtcaagagagccgtggtggtttgtcagcatggcagacgtttgtgagtgtgtagattttaattatttaaacatttaattttttaaattatttaaaaaattatttaatttcatgttcttcctggctttacaaattgattagaaaaagcccaagaactgaaagagagaaggtaggaaagaatacaaagatgaagggatataatggaatgatcagcgaaagtgtttggaagtaaaggaagtaaggaaaagtgagggagaaggagcttagtgtgcatctgggaagtgagccgattacacctctggggctgggggaaggttaattgaagacaagaaagaatgtgcttggcaggtgtctgaaatgtaactttatctttctatgaaatggaattcagaatagcccaaatgcccaagtcaccataaagaaggtatgatggtacaatgtatgtttttgtttgtattttttttgttttcccaaaatggctcatgtatgaagtaagctcttagaatatctcccactactattgcaaatacaaacataagagaaacctatttattaacgctgaactagtcttatagataattcattatgcgcttgctgaggatagctgttgcctgggagtttctttatagttctcctcacaagagttttaatagctgtgcagcggaacttcacaccaaactttgttattctcacccatcatatttttatcacaaaaatgtcactctgaaaggagaagctcactttcccagtacctttcccactttatttcttgcaaaatgtaatttggtttatgggctgctactaataacttgcaaagtctgatttctactttaagccttccattgtaataacacctcatcttatttttgaaacacacagaaactttcataactctttgactacctttaactcattgatttctgaaaaactgtgaggtaggtcagtgtggcttttagctcatgtatttgttcaccctatttcttggtgtctttcagctcacccagggctttgtagcatcagctgtatgattttcatacttttactaagaatattttgtatgtctttcttgtctaggtgcctagaatggctgccatatagtagacgctctataaatatgtgtgaaatagtaattaaaccagaatcagtgatttccattgtgctttgttttagacatttgtctccaaagagaatagcttacttacgttaatttcatttatacaaagtttctaccactgagccatgtgaaacaggacatactgaaaaatgttgttctaatacttcttgtcatctatattaagcaatgatttcagcctggtgcatgggctactcaattcccctctgaggctttgattagttcgctttttaaccagagtatgcaaaatgaaatacgaagtactcaacgctcagatccttgaattctaatcatgctctatgacgtacccatcataatatctgcagagaatgcttcaacatcccagatctaaaagttgtggtcaacatttcctatgccagctgtgttaggacattttagagaaataaaaccaataggagatatctcaatagaaagattagatagatagatagatagacagatagacactctctatatagagatctactggctctgtttatatatgtatctctacatatatatctatatgtacatatgttgatttacatacacatgtacaagagagagatttatcataagaattaatggacatgattatggaagccgagaagttccaagatcagttggcaaggtggagacccaggagagccactggtgtaagtttcagtccaagcctcagcctgaaggcagaagactgatgtcccagccaaagcccatcaggcagggagagaaaataattccttactcagcctttttgttccattcaggctttcaaaagataggatgaggcccatccacattagggagggcaatctgcattactaaatctactgattcaaaagttaatctcatgcaacaatgttctcacagaacacgtttaaccagatagctaagcaccctgtggcacaatcaaattgacatacaaaagtaacaattacagcagccatcatcagagaactaccgccagccaatataatttttttttttttgagatggaattttgatctctcgcccaggctggagtacagtagtgcgatctctgctcactgcaatctccgcctcctgggttcaagcgattctcctacctcggcctcctgagtagctggaactacaggcatgtgccaccacagccagctaatttgttgtatttttagtagagacggggtttcaccatgttagccaggatggtcttgctctcctgacctattttgccaaaatggtgaataagttaatgtcaatatgtatatttgtcagggaaaaagaaaataaaatgtaaacaattagaaacaagcttctaggcaatgttcctatgaccatatggctacgcttaatagtaatttacgttgctctagtcaagagtgtttattttaggtcttcagtctgtttgaggaaaagctgttttgcatgaccccagcttggagactgagcacagagtaaagtctaggatagggtagagtactagtgaatatactacagatttcacctgagtataatgaagaaagtggccacatctccgttccagccagcttcccataggacttgaaacctccagctaggagatgctccagagggatctgagggtcctggcttttaatagttcacatcatacctatgaggactgtcagaacaagttcatgaagtaagcattcccctgctgccccttcctacaaataaagaatgaagaactgagaagtcaaatgaactcttcaggtgaccacaattcattggtagcaaagctagggccagactccagtgtgcttggtgctgggtgctgcactgataagtttattgataccatgatttgattctctgttacctgaagacctcaccttttcttttacccttattcaagtgaatattgcatctttttttgggtgggggggtgcagcttagttcctgtcaatgactgccatcaaaaatgctgaccgggaatttcagaattgaacagttcaaacctcctctgcaggttgaaaagatgaatctcacattttgcacatccatctctgcagaatatagtcatattctgctgcttttcactatgtgggatatatatcacttttaaatggcgactgtggcctcttggcacactgggaagtgattgggcagcttaaccagcttcccttgcgtgtgatagagaattctgaggcaaagcccaggctttctttccccacaaggacagccattgccaatcacgtttccttatttaaaattactccctggagaaaattaagcatctttttgttttgcttcctttaacagtctgtggtttcatgcccctcctgagccttacctgtcttgaaaagcaaaaaccacatcctttacccctgaagatccagctggtggtatacggcaactccttccctgatggcattgtgttctgattccttagaaagcaccaggcatgtttaccttttccttaaatcttcaatctccgcacatcgttttgggcagggcaagataaaactggggtgatagctcatccggggccttgccaaataccctaccattgggacatttatattagatatagatttctgcttaatagaataagccaggaaaaatcacactccttgttggcgttcaaaggataaaccataaaagccattaagaagtactgtaagcatgaggatgattaatgggactcgaggtgctgtccactgactatttccagataatgtctttgagagattccattgcctctggtggccattcagagctatttatttgcaaggtgaaattctgagtaatgatgtttcctgggtagctctgactgacagcgttaaggagacagaactggatggccctgaactcagatcataaagggtttgctctcaggagttgctaggatacttcagaggttgtgcatggaaagacaatatgtctgccctcaaattgcccctccttctgtgagcactgagtcttctcttgaggacctcctgggcttaaggtttatagggaagaagtgattgtcaagaactatcgattcccgacttctatgaaaccagtatgaattttttccttccttgaattggagttagtttggactgggacaggagtgagcatcctgagggcaatgccctcccaggacctgcaaaacttgtggtttgcatttctttttaaattgacagaatattatgcaaagtacttcaaattgtccatcattctccaagtttcatttgttaaaatagatcccatctgccttcttaagtgcaaactctgacaattattttttaacatctgggttgcaataatgcagtttgtatgtcgatatggttgttgatgcttgaaagtctaacttaacctttccagcaaaacaaccagaggaacccaggctctcatcttgataaaaggcaccacccagcacggcctctgctggaaaggagaccttcaataaatattagatgggtaggctgggcatggtgactcacacctataatcccagcactttgggaggccgaggcgggtgggcccctgaggtcgtgagttcgagaccagcctgaccaacgtggagaaaccctgtctctactagaaatacaaaattagccaggcgtggtggtgcatgcctgtactcacagctactcgggaggctgaggcaggagaattgcttgaatccgggaggtagaggttgcggtgagccaagatcatgccattgcattccagcctgggcaacaagagagaaacaccgtctcaaaaaaaaaaaaaaaaattagatgggtaaatacattggcagatggatggatacatggatgaacgggtaaatgaatgaaagctaccatattttgagcacctataatgttgtataaatcagtcatttatataacaatttataattttgatattattcccattttgcagaagagaaaactatggctcagaagtgactcgtccaaggtgatagagacagggtttaagtgcaaggttattttacttttcagtctagaaaagggaaagatggattcaacagtaagtagcttcataatgtagcatgagttcattgtaatttctactttacatgaagcaaattattattcattttttaaaaaatggttaagtttcatagatttcaaagtgcatatccccttttctttggatatattcaagtaaaatagttggtatgcttaaaaacttgcgtagattatatttttagaaaatcttaaaacttcgttaggatctgagactatgttttaaatatttacttgggctggtatttatcttaaatcatttctgatgggtggtgaggagctgaggttagaaacatatggatgaataaaggcctttttagttgtggtaagagctaagcccacatttctcagcctttgtttacacgttgactcactgtctgagtgagcagtcttggatttcttgcctgctcctattctccagagctctgaaatgccaggctcctcacctaaacacagaccgtccgtgcagtccgctaagccaccttaaggtttcgttcataaggtttcttgcagtcccatcttggctaactgaagcttatctactggtggttttacctgtctattctgattagtggtaacaactatgtttcctctaaagacccaggggcaacagcagggagagactagttcctaagaacaattccagttattctcagagtattcccttgtagcttgaggttgaggtgcatcatttccaagaagacagtttatccttcaggaaaatttttaaaataggaaggaaagaaggaaggaagggaaggaaagaaggaaggaagaaggaaggaagggagggagggagggagggagggagggaaagataaaagattgttccctagttactcctttggatcatttcaatgattattttctctcaacactgctgcaggttacttcaaagtaatcagcaatgctatcctgacagccaagattcagatagattttctatcaactgagccaggctctgatagtttatcactgaaaataataaagatgataataataatagcaaaaatacctgccccaattatgattgacaaaatgtcatggggagaaaagaagtatataattgatggcagtcattaaacatagacagagactcaggaggcggaacccaaaccctgaatggtcagaaccttcgtaatggggaataacaggaaacttaaccctgagctggtgttatggcaggcacctgatccagtgtgacagggtaacgatttatttcttcagctactgatttttagaacaccacagggctgcggaagagaggtaaatttgctatatcagagcaatattttatatttttaagccgatatacaacactaacttactaatgatttgactacattttaattcctctttcatttgctcctttactttctaattttttttatttgatttagtttgttttagctactattcttctctttacttttttgttatctttcacctttaaaaacataaatattacctttcctccttttttttttttttttgtgcccaactgctcagcccagctgctaggttaatttttgatgtctctttatacaacttgtcatgactttcttcatattagctttattcctctttactcctcttctgttgtctttcctctcccctttggcctaagccctgctaccttatcttttcccattcccaataccatacctctctagcacccattgggtgcctctgtcctatgtaggcattattcttatcccaaataacaagggtggacttgtacccattctgccttctctcagggaaagggcgcagtaaggggcaggaggctctggggggcatgcctacacctggggggctcttggccttgtgaaataactgaaatggtttacctgaaggaaagcgtatcacctaacttggttctagacttatcacagactattatttaaatctgctaggatgcttaatgtacagaaacattgaaccaaaggagaagataatagaattacaaagtagttaaaaatagaattgttatgaaatctaagttcagcccagcttggaaaatgactgaggagatctattggttgacttttaaccactcctggaagaaacattaagcctctttcttgacaggacaagaaccccagcctgaaaggtagcctcagcttccacagggcagtgaggcagaggatgacagaggggacctttcatgctgggcatggttttgaggatggccagcagggcttgcatttccttgcaggatagatgtgtgtatattaattgcctctgcactgccagccacagcatttcccagaaaaaaaaaaagaaagaaagaaggccttcttgaaacagagaagtattcattttacattgtaactaatgatactcagctaatagccagggagcaaggtggcatgacaggaaaagaaatcaaggcatggaggatggtagcaaaatcaggaatggggagccctcttcatacactcttttattcacccgctcacattcttacagataggagtttaacaccgaagaaaagcaattaagataattttctagagtcagacacaccatgagtctcatatcttttacatctgaccaaaggaggacttaggcgagttgtttaatggtttctgggcctcagagtcctttctataaactgggagtgagcacggtggctgcctcatgggttccgtaggcactggaaatctttgtcctgccagtcaccagatatgcagactgggccaggcctggagttgctcacttgtggaggtgggtgaaaatgtgccctgttgtcgcctgcacactcaccaggtggggagggtgtcacgagtgattatgtacctggaagccttttcgatccgcgattcgtttggcagcacgccagatctgcaacagcccatagcatctggttgcttggaaaatagtcacgttcaggaggcagatttaatggaaaagaaagaatatttagaaaaaaacaaagccttaaatacttgtagagttatatgcaggttatattcttctgaatatctttagaaaaagaatttttccttttgctcttcttcttgacaaataatctttgagcacaaactatgtcccaggcaatgttctagtaagtcattgataaaaggcaaacacactgatcaaatctctcaccttgaagataccaataaatagtttaaaacaacataatatgttagaaaggaaacagtgctaggcaggaaaagtaaagtgttgaaaggggacaggaagttctagaaagatgggataaaattttagtatgaataagactgaattcaaaaaccaggaaaagtcagccagagaggcaggttcggtaaagggagttgatagtgaccccaggtaaggcagatttcatttaagaataaatagaaaaacaaaacaaaggcatacatacattgatgagatctccatggagtcaggagaatgattactcttctggaatattctgcaaagctgaagacagttctagaaacagcagcagagtgcctttgtccaaaacatggctatttgagtgcgtagtctgagccaggcactgttgcagatgaacagaggaagtgcctaacatcggtggcgcttcatcccatggagggagaccgaagctaagcagtggacataaccaataactacatctatttagtgctatgccgcatccatggggattggttccaggaccttccacctatacccaaatccaggaatgctcaagtctctcttataaaatcatcttcagattacttacaatacctaatacaatgtaaacattatgtaaacagtcatgatattgcattgcttagggaataatgacaaaagtctgtacctgtcagtacagatacgatttttatttaaaaacttttctgatgataatagtatttgtacatatttatggggtacatgtgatattttgatataagcatacaatgtgtaagaatcaaatcaaggcattgatgtgcagttgattgaattcatggatgtggaacccacagatagggagggctgactgtcttttttttttttttaaattaagttaaaaaattttaattaacgagtgaacatgtacatatttatcttgtacaacatgttgttttggaatatatacatatacattgtggaatggctaaattgagttaattgacatatcattacctcatgtagttatcatttttttgtaatgagaacacttaaaatctactcttttaggaattttcaggaacaggaaacattgttattaactatagtcactgtgttgtataatgaatctcttgaatatgttctttctgttcaactaaaattttctgtcctttgaacaacatgttcataagccacacctccttacccctagtaaccactggcaaccaccattttactccctacttttgtgtgttcagcttttttagattccagatataagtgacaacacttttctttctatgcctggcttatttcacttaatgtaatgtactctaggttcattgatgttgctccaaatgacaggatttccttattttaaggccaaatggtatttcatcgaatttatctacaacattttcctcacccattcgtctgttgagggacacttacgttctttccatattatctcggctattgtcaacagtgctgcgatgaacatgagagggcagacatctcttcgacagtctgatttcattttctttggacatatacccagaaatgggattgctggatcatagggtggcgccatttttattttttttaatttgaccagagcctacttcttagaatatttttaattttttgaagaactgtcatcctgttttccataatggccgtactaattgacatccccaccaaccatgtgcaagcgttctctcttcacacactggccaacatgtgttatccttcatctttttgtaatagcccttctgacatgtgagtaaataatttagtctttattggcttaattttattgccctcgagaaaagtggcaggatggaggcagtaatctcatatttattggaaagaacgtgcttgagcctagaatcaagctgactgtctgaactcattagtcccccattcctgagcaagttacttaaattctcccaatgtcagctttcttatgcttaaactggaattagtaatatctatgttatgtagttgcggaaatgaggtcacgtggttaaagaaatctagtgtgtagtaggtaggtgtggagcttataggagggaaggggcgttacatgatgttatttatcccaattcagtaataattatgatttctacactcatttaaatagatgatgtttgactgtttttctcaaacatggatcattattttttgtcacactttgtaaatgaacataagaagcatgagaggtgcatctgtgctcaggagaggtgcatctgtgctcagacctgccagtacagcctaatatttttctgaatcttgaggcagtcaagttgcccatatgcactgaggcccactttatgtagagtgtgcttgggacacttccagagatgtgcacaattagctaaaacagttttgtcctttcagaatttagctgagaaaatgacagtccacataataagatcattaatgatataaggcaggagattgtacagatgatgctgtgggattttttgtatttcttcttgaggagctcatcttactaagttcaaattatcaaattgtgtttaaggaaaaaaggttcattatttcatcatcctcatttttttttaaccatttgtgggtcattcctcccaggttgtaagtatttttattcagatgcatgtaggtgttcgatatttacccttgtaatgttaaagatgacaggatactgctctcactttgctctgttatataagctatgtgttcccaccagccctccgcatcttccttatgtactttggtgggaaggaggaggcggggtgtcaactctctttgcccttgggctgtcacctggatgggcattcggtgtttgcttctctggcagctctgtgccaggcctgggtcttccttcacactagagcaggtatgttctggaaggaggaatccagtctgataaactccttcgattcttcatgctagccccatggggtgggagtggcccctgaggctccagtttccactcttggcttctattctcagccctggctctttctcccccagtggtgcttttgctccaactgctcatggagttaccgccataccccacattcggagaatgcctctctggctcacagacttctatgccattcctcagaacaggccacgttccccacagcttctccaggggcgcatcctctgggcagcacccaagcctttccacctgtcctgagggtaaatttgagatcaggcactcacgtatgcatacacaagcacacacacttgtgcatggacacatgcacttcctgccctcaaagtcaaacaattctcagagaaggcagcctaaatccactccaggtagcagaaacctattagtaacggcagcatcctctggcccatcatcctggcctggatgtgtcaagggagcagtcccagcccctctgttctcatttctgggtttttaagcccacagtgctagaggctgagagaaacaatggccctttagagtgtcttccctaaagaaatttggtgcaactgtgttcttccccacgggccagaagaacagcttagattggacttcacacttcactaggacaaccctttgattcctatttgggacacaacaaagggaggaaacaaagtttttttcaattatttagaaagtgcccattgacataaaggaatgttaagtgacttgtctaaaaacaacgtggcgcctacagggctgacactgttcagggttcaatcacctgataattcacaacattttctttttgctgaatttcatgcacctccttaccccaaacatatataatatatcccctttgtaaaaaaaaaaaaaaaaaaaaaaaaaaatcacagcctcaatggaaaaatattagaaaccaaacatgattttatgggctaaaaattccattcctctcatcatttctatttttgaccttgttgcccagttatgagaaattgggaaaggcagctcttggtgcctcagtttcttcatttgtgaaactgagaaaataacacttaacccctccccgctttccacagaagtagcaggcttaatacattagtgctagcaaagcactttacgctctcagagtacctttcacaaaacaatatcaaagcattactgcatctattattaacaaataagattggcttgaacacggagccccgagagaacttctttgtcacttctctgcatgcagactgagtgacattttctatgaccttcttcactttgcctgccaacaacctgctcattaacatggatcataacactgtttggtacttttccactgcctttcatttggaaacctccaaatgccttgctaacacgattaaatcaagtatcctcaaacataggttaggtgttacaagaaccattacacttagggcagtgggcagagagatccaaggaatggaaagttaagggcaagaagtagttccactcactgggtttccattcctaacccagaaacgaataacccttcagctctttgggtctctcatccccgcttcttgaaagcccagtctagaatgttagaaaattgcagcagattcactggtgtgctctattttcagctacttccataaagaaatcaattcaatgtgtctgacagtctacttttcctgaagctctgctggcagagggcttaactttatatcatctttcacagccccaaaacaaaacaaacattttatttcatcctcaatgaaagtaacttctatttatcttggtgagattcccatgctaggtaatctgcagtcaccagtcggatttcctttgttctcggcacttttgggctattgcattttagtgcctgagatgctgagtccgtgacagaggaaacatcttgtcattttaatgaattgagttctcccagcgccactcttctcaccaacagtccttttccattcccatcaagacgtcagatgcaaaataaaactgcaacatggcagagtgtgcaagaacattcagattattactgaattatgtggctggaagactctgagagatcactttcctcatctctaactttttgagatttttctctaagtgagctcaaattattacctgttataacagagctttcaaatcacaaagggcctcagcaagtctaagtgaaaaggatgtgtcatgcattgtgttaaggaactgtctaagcctgggcttgtttctcttggcacctagctttctgtgactactcacacatttagaagttgatcagtgaatacaaatgagcaataacattatacagaaggaagatcaagggacttgaagtcaaagtacagagatgcaaattcagagctgtgtgacctgaagaaagttgcttaagtttcctgaattttgttttactcatctttgaatcaagggtattgaaatctacttgatctccatggacctcacaatatggaaatgatatcttgtaagataatatttgaaaattgtctgtatattcgaaaatgttatgcaaatattcgtcattattaacaatgttagtaaaaactaaacctaactgcaaaggaacatccacagtgaaaaatgtataatgcatccaaaacacaaacacaaatttcaaaatccacgattgttccttgtcgattatgatgattcccttctcttggtacaatttgagatgaaaaagtcaaaaatcgacaaaaaactaacaagacttccagatgaccaattgggattgttttcttggtacagtgcttcaaaagagacacctgcagtgctaagaagggcctacttggatgacatagccaaggtgtatccacagcttaataggatcacaagtagcatttgatgatttcatgatgcgctttatagcatccccttggtgtggcagaatccctagcttcacaaagaatttacctgaacaaatggcttgactttttttctgcctcagtttcctcaggaatgaaacaatttatgttcttttgttggccacataatgtaaacatcaaaagcaattctatgtgcaagtatgtggaagtgctacctataatttgagatcgcattaaagtggatccttgctttttatgtgcaatcatttttaagctacttttttttttttcctgaggagaagagagaaggatggctaggactgaactaaagagtgctccaaggagatgaaatttctaagagtcacagatgaagtgaaatatgacaaagtgtcagctgaccaccaggaataaacagattcctggcaatagccattattagatcgtggaattgcctctctcaggaagtggtagaaacatttactgctcaactggataaagtactctcaggggccagatgacctgccatttccttctacattatctatgagttttttctaataataataaaaccactgaaattggctacagagctataatcactcatatataggctgggagctgcatcgtcatgacagcaggccatgttctcagatcattgctctcgatttggccttggtcttggcgactcccccagtctgtttagtgctaggtccaagtctacagaggactgataatagcgtctacactggccttacatgcatttaacaatgttgagccactactttctaaacagtaagctggattcaggcagcttcagaaataccatgaaaacatgatgctgtttaaatgctaatgctgaggcctagaagtgatggtagctggccaggagccgtgtttcctctgttgggctgagcgtatgatttcatttctcctatttgttcagttgtagtaaacatttttcatggagtttttacagtgtttgcaaaaatgcctcctaagcaaaaatcgaaaaatacactttcttctttgtacagttttcaaaaatatactccttttgaattgaaaaaggcttatgaaagaatgatgaacaaaccatatttgatatttacaagtgttattttcttgttattaaattcagtttgtaagatgtatgtatgtgtgtgtttgcgtgcgcgcgtatgtgtgtgtgaatctattcattcctctacttatcccctcgaaaaatctcattttcaaaatttcataatattttttaaaaaggaaaaaagaatgacctgcctgcatcggtaaatcaaaagctaaaatgctgactcatgcagcaaagcggcctgacttgcggagctaatgcccaagtgccggctctatcgccctctgtggcagccaggggctcgctgtccgctctcccaccagcatggcttcaggagatgagcccttcactcatagggcatttccggctctcagcatagtgcctggcccagggtagatgctgagtaatcgcccattaaagtccagtatgttgttgttgctgttatggaaccattcttacaaagaatatcatagaaccccagatagaaaaaaatagatagatgtttttgggtagagaaccactttcaagtgagatccttactttgtgattcaagattttatgtgtctttcttctttcttttaatctgaagtgcattcccctatcctgcttcatggtcatgatttcattcaaatttattgaattcctacttgcaattctattagatcctacaatttatagatgaccaatggcagagaaattttagacctgatttttacatactgctttgcagttaaagtacttttctttgcataatccaaagcattgattgaaccctgtgaggtggagacatagatagttctacttttattttataaatgaggaaactgaggctcagggatgttaagtgatttaactgaagttacgtggtgagtgagtgacagatttgagccttaaacatatctttggactctgtagggtttttcccttcaccttctgaaggtttgctgaaaaatcaattcacaaaaggcagattaattggagaacaggtacacaaaacttattaacgtgtacatgggaaccttcaaaataaaaaatcaggctgggtgcggtggctcatgcctgcaatcccagcactatgagaggccgaggagggtggatcacccgaggtcaggagttcaagaccagcctggccaacatggtgaaaccccgtctctactaaaaatataaaaattagccaggcttggtggcgcatgcctgcaatcccagctactcgggaagctgaggcaggagaatcacttgaacccaggaggcggcggttgcagtcagctgagatctcaccattgcactccagcctgggcgacagcatgaaaccctatctcaaaaaaataaacaaataaataaaataaatagaataaaaaaaatcagtgataacagggaaaattgtccattttcctgcttaggttcagcaaattatacacaaccatgtagaaataggattggacgcaaaggtcatgatctaatgctaacagactgagtggggaacccagccaggcccgtgtagattcctcccggcctctaggagcagcgtccctcccttctgggtgtgggcgtcttatggccttcagtcaaacaaggcaaattggatgatttctctatggccagttttaacccagaaaggtggaaggaaagttagagtcatagttttaggttggatggccgactttggagaaaacgtgttctgacttcagtgacctgccttgaggaagagggattctggattctgccgccagcctcaggggaggttaagactgagagacaggagggctccagaaagccagcgagaaacttttgcttcttaggctgcttctgaggccttcatttgggagtattgtttgctgagacccagcaactcaaaatcacttcactaagaaagaagtcagtatacccgttgtgtcatattcacacacgtcctcactgcctagctctcttttcagctgaatatgtttatttggtcatgtcctcctacgtcaaaagctcccatgtatattaattcatgcaactatacttgtggtcactgcaaaaggccagcctggatgccagagtgagcttgttgggctcaggattttctgctgcaaacacatcctcggccgagccacgccccatgcaatgtagctacaggcaggaagggtctgatcacgccccatgccatgtagctacaggcaggaagggtctgatacatggtgactgctcagtggggcagatactgaggctgcccacacccagtctaacaatagacaggcatacagtgtatgcagagagtcaccttaacagtggtagaaggagtagtttccttaaagcaaatattttcttaacctcaaagaaatatctcagtgtaaccatgccagataaggttctgcataaagggttagctttttgagttataatcttcttttatgaaagaatagcctggaaactttaggtctcacttgtgtgtaaggatttgaaatattttaagccaaagagaaaagctttagagaagagtttagctgccaggggcttttttctgtaactcacagtgatgaggcaagggaaggctagcgcagaccaggagacaggccccattaaaatcttattagcatgctttgaagtgacagtagtgccacgtccgaaatatctccccagcccaccatctttctcagctgcctgtgtcctagctaggatgctgggccacaagcaatggaaagcaccctgagctggaatcttgcttcatcctgaatttatcccaactagcagtttgacctatgagatgccatgtgcacctcttgtactctcagagttttttttttttttttcgtatagatgacagagctagatacgatgatgtttatgagcctgtccagctctaacctgtgtgaatctttaaggattgccgtaccactttcattggtaggaaatccagatactgtacattggaatatttcaaaacgaagtcaaattggaaacagatgatgcacccagcctacccgaaacttggttcccatctgcagtgcagatgtaagccaacagctaacatggagaagtggtcaaaattgttgggttctttgaaaaaatactaattattaaaagtaataattaacacatgggaaaatatgtctaaaatacatggtatttttttcttctgaaattaaaatgtcctcttaaaagccatttaaaaactgtgtcattctagcttccttgctaccattgcttttgttgtgcagaacatcattctaaatttaaaggctggtaaacatgcaaattgaagatgtttgctaattcaagttaagagaatattcagattaatacaatgtaactcgaagaaatgatttaaaggaaaacaaaaagactaaacaagtaccagcatccagtaggagtaaacttattttcatactcagttaactagcttaaggagagagtaaaattaaaaaaacagtttttgttttttttttttttttttatttgagatggagtctcactctgttgcccaggctggagtgcaatggtgcgatctcagctcactgcaagctccgcctcccgggttcaagcgattcccctgcctcagcctcctgagttgctgggattacaggtgcacgccaccacgcctggctaattttttgtatttttgtagagacagggtttcaccgtgttagccaggatggtctcaatctcctgacctcgtgattcacccacttcggcctcccaaactgctgggattacaggcgtgagccaccgcgcccagccaaaaaagcagttttaaatagtggatctcatacactgtgccagacaaagtgagacacatacaggcaaacatctatttggatgcaagtacatatgtatatttgtatttataagcatatacatatgtagacatttttgaatacataattattttgaatagtcaatataaccttaacacataggagttattttcctgtttttcagtcgaggaaactgaaattcagaaataactaacctggtgtcccttagctaataaatgaagaagcccagctttgaaaacaagcgcctagcccttctaaagaaagttgtctttatattataccccatttcctcaagtaagggctttgttataaaacatcccgagagcctggtgtttagaaactgctacatttaacttaaataaagaacacgagttatttaacattttgagttttgattccttcatctgtgaaaacgcaaatgaaaatatctactttgggagacagttggtgggattaaatgagatacagtgaattaaaatatctgcaaaagtccctggcaaatcgtggccttgtacaatatattagtttgtatagcattttagttgcagtttctccaaatctcttcgcacttaaatcttttttgttacaaaaagagaaacaaaattttgcctactacctcaaaggagtaaacaagtatttactgaatgccttctattatgtcataacgttttatgtgtcacatttcggagctgattgaggtcatgattatggaatgttttatgtggggtggtggtagttaaacagtaagtacagttacgtgaatctagcttttctggtgtccccaagcgttcaaacagcttttttggtaaaatgaatcctgggaaactaaaagtacccctaccttttgcgtttcctgctgcctcagtccctccagtttgagttagttttcctctagaggctttggagggaaagttttcctcttgccacactcaccttgaagcaggacgtaatggattgccgtggctttcactatgcatcttgtctcaatacaggccttcgggggacaggcctgcgacattacccagtctacaaaggcaggtaatttaataaggttatcatattttccctctctataatgacttaagaacacccttcttaaaaagtcatgtcaaacgttgttccatttaaaaatcagttactgaataaggcaagcgggatatgaatcagtgggcacatagtataactcaagttttgagatgaaaactggccctccaggcctttgttctgcatcaggttcaggaacatgagaagtgtgtggctgtctgcaagttattaagttccctgcaatagaaaggcatcaacagacaatctcagtaaagcatctttaacttccatacattcagctttttagaaatatttacttacataattacacctgactctcataagctgctttgcatacacgaaattcagtctttcctaccacagttgatgtattaacctttccagagatcttatgaagtgctgcctgtcagctaatggcctagtgtgtcagccttgtgcaggtatttgtatggtaatattgtgcatgcaattatttgaatgctttgttgcattttccccttttttaatgaattgaaagcagaaaatgaaagggttagtattagggctaggaagctgaggtctcatatatatatgtagctgagcccatagtaccgttgagaaaatgatggaaatgaataggcgtgtttacaaaattaagaacatgtgaaatacgggaagtattttgttgaaaactgtccctgaaatataaagtgtaattaggaagataatattttcattgtgtactctcatttgtctcttacaaaacactagcctttgctaacctttaacgttagaatttcatgtgtgctttcaagaaagctccgtctggcaaagtaggaagctgctgtaataatcaaactctgacttgtgctagctccagtctatcttttctgcaggacgcagatgctgctcctaaagctttcttggactgagaagacttttctcatttctgaagtccacacgagtttcctcattactgaagaatgcatttcacgatataaaacctaatctacacagctgtatgttgtttgggactcagttaacttagaattgattctcttcctctgtacagtccaggcaattgaaataagttaaatgtttttttccaacatagccacccacatttaaggcatggtgacctaaagtctttccttgagaactcgcacctctgaaaacctgatactttgtagaggcatatggagaaactcagtgtagcatacaaggtatgcatgcttcttcatggctgcaccgtccactccttccttcagtctgctcttcccccaaagtgatatgtgctttcatttatcatcatcatcatcactatgattttaaatcacaaaaagtccagctgccttatttcacatttttttaaactgtggttccaagcaaattctgaaatgaaatgaagaaaggaaatatatttcagagagaagtccaactgagagaaaacaaacgagcatatttaatatttaaactaatcaatcaagtacccttggctcaaagaaatgaagagaatgtggaatactcttctgatttccaagtatacacacacacacgtataaacaatgctacttagatcttttgcatttctgctgcgttacctcatagtcggctacctttatgttagtttatgaaataatcacaaggacccattgaattaggtttgcgaacgtacttttagatttattcataataacgtggcttacactgatagagttttatatttaaaaacacttgcatatgtatttctttgattaatataaggagaattcatcacccatgttgtggatgagaaaatgacactcagaaagactaatgctgctaccagagtcaggacttggatgggatttctgatacctgagccaaagttctcctcaccccccgggaagaaaggggcctctgggaaatccctcttgggttgggtggagcctcacaagtcctggaggctcataacctctccacacgggtcactcccattgcccttagctagttcccagcagagttcagcaatgtaagtatcattgtcaaaggcatctgtgcttcttgcaggcagagcaagggagggggaagccgaggaggtgcatgcctcctgcaggcagatgggaggaactgtggaggcatttcaaagaggaaggaggcaccctggcaggcccggtcaaagaggagggaacctgggagcctgactgagtcgggtgcagccatcagaggaagcagagcagggtgtcactgtagtgttttggtgacaaccccagagcctgagagctgtgcagacaggctacggatttgagttttcatgtgtacagtactgcatttatacagttagaaaattaggctgtcagatattctcttccttcctagtttttctcaatgagtggagtttacatgtgtgcatgtatgtgccagtgagaaaccgccgacttctgtcttcagagtcctcccctccctctctctgtgttcacataacccaccggcttcctaaggacgccacactgtcctcattgcctcggggttcagtgctcacccacacctgtctccccagggtaacacttagagcagcaattctcacactctgtggtctcggggcctttttacatgcttaaaattgttgaggattccaaagagcttttgttcatgagggatatgcagcaatacttccacatgacaaactaaaactgacaaaaaatcaatgctttttaattctttgaaaaatagcaacacaaatttcattacatgttagcataagtaatttttatgaaaaatagctatattgttttacaaaacattaatgagaagaatgacattgctttatagctttgcatgtttcttagaacgcagctacagccttatatctggttttacatttaatcagttacagtatatatatatttttaagtatgtaaagaatatctggcttcacacagattgtagtagaaaaagggaggattttcatagattgtgtgatagttgtggatattgttctttgatagtataccaaaactcaacaagtgatactttcttaaaaagtagttgcaatgtataatcagaaaccatatcaattaaattttcttcctctgttacattaaaatgtactagttttttctttactatctttgcaacttactgtgaatctgtaaatacttcaaaataaaaagtttaaaaattgtacaaagaatttcaacacacatttcttcatggaagatatacaaatggccattaatcacatgaagaatattcaacatcattagtcattaggaaaactcaaattaaactcgctatgaaatacttcttcacaaccatagaagagctacaatactttggacaataacaggagttgagaaggatatggggaaattggaaccctcattcattgctggtgtgaatgtaaaaatggtacaattgttaacattggtaaatccgtatgggtctgcagcaattcaattcttgcctccccagagaaaaaaaattcatccaaggggcataaggcagagtgagagattgaggcaagttttagaacaagagtgaaattttatttaaaaagttttagagcagggtcaaaggaagtaaagtgcacttcaaagaggatgaagtgtgtgatttgtgagatccaagtgtgctgtgcggcctttgacttgggcttttctatgttggcatgcttccggatttgtgtctctcctgatccttcccttggggtgggtgtctgcaggcacagtggcatgccagcacttcggaggggccacatgcacagtgtgcttactggtgttccatgcatgctcactggaggtatttttccctagccagttgagtattcctagaggaaggtcatataccagttaaactctgccattttgcctcatagtgtgcatgcttgagtcggcttgtccacctcctgagagcttatcgggaagctactgatcaccagcttcagctgttttctatcaattgggagactgtctttccctggtgctggctgtgaccaattcttattttagagagacagtttaacaactgcatgaccatcacctgatagacacctgacattcctggagcggggggcctctcctgtcctcctcatgcctgtctgactacttaccctaacacaatcactttggaaaacagtgtgactgtttctcaactttttgtttacatttacgccatatcctaccaaggtattatttgatagccatcatgccactttcccaggttaaatcagttcccatttcttcatattattgattatgcttcaatcgatttattgattaatttttgtgatacttgctgaaactgagaactagttttcttctaatctactaacctaataacattatttataaagcaaatttttatgcctaggacatgactattagctcaaagagattaactgttaggtctattgtattggcattcgagtgtcttatagtcaaagcactcctccttagagaagcaaagaccgatttttgaaatggaatctacagtgaaatcatatgtagctgaactgtaacattatcttccattagacatcacaccaactggtcaccaaagggaagaaagtatggcttcttaaaaatgcaattaagggtcttgaagctgatcttgtcagcacaggtgtcgaggctgaggagaaatctgagaaaactgcattagttatcttttgctgtataacacattaccctaaacacaacagcataaagcaaatatttatttcacaatttctgaggctcaggaatcctggatggattaggttggtggttctgcctcaggcactctgatgaggttgcaactaggatgtgagctgagtctgcagacatctgaaggctgcctgaccagggctggaggaatagcttccacagtagctcactcacatggctaaaatgttaaacatggagttaccatgtggcccagcaatcccgctcctatatattaacccgggagaaatgaaatcatattgtaatcacccagagtggtcttcatgcctgctgcacagataaacccaatttgctgagacaacaatattgcagtaaatgaagagtttaattaatgcacggtgagccaagtggagaagaggaatttattattactcaaatcagcctctccaagaatgcagagactaaggcttttatggataatttggtgagcagggggctagggaatgggtttgctgattggttggggatgaaatcacaggagtatggaaaatggcccttgcgcattgagtccacctctgggtcatgagtgaaaacactgggtgtagtcagtcagttaccagaatgcagtaatctgaaaaacatcacaagaccaatcttaggttctataatagtgatgttatccataggaacagatctttgaccatatgactcctgagctgtaaggaattatacaaattatgcctccattttagcagaattcaggcccctcccataatcctaatctcatagccttttattagctttacaaaagcggctttggtccctgggcaaggaggggaatagttttagggagtttcaaagtttaactataaactaaatcccttccatgcttagcttggcctacacctaggaatgagtgaggacagagggcctgtgaggctagaagaaagatggagtctgttatgctagacttctctctgtcataatctttgcaaaggcagtttcaacatgtcccacaaagacttacatgcaattgttcatagtggcattactcagttactcataatagctcccaagtggaagcaaccctgatgtctatcaactagtgaaagcataatcaaaatgcggcatatccgcattatggaatactatttggcaatgtgagattgtgatttatgagaaatatatatttagtttttatccttgtttcctcccatacagctcctaaaacctttggaatctcttcagtgctaagagtccttttgcatgctaatgagatgactgatggctgggggctcctgcttagcctcaggataggggctgcttgccaggggaacccactttgtgattagagccttggaactttcactcccaacctccaacctggagggaggggagaggacctaaacattgatttgatcaccaatggtcaatgatttaatcaattatgctaaagcaatgaaagctccataaaacccagaaggactgagttctaagagcttccagattgatgaacaagaacacatccaaatgccaggaggatggtgcaccccaactccatggggccagaagctctggcacttgggatcctcctgaacctctccctgtgcatcttttcatctgcctatttgtatcctttaaaaaaatccctgtattaaatcggtaatagtaagtaaagtggtgccttgggttctgtgagccgccctagcaaatctgccccaaggggattgtggtaattccctatttatagttgtttgtcagaccaaacagcctggggcttgatattggcatctgatgttagggcagtcttgtgggattaagcccttaccctgtgtgatctgaggctagcttcaaatataatagataacgtcagaattgagttaaatggtaggacaccattgaacacaattaacacaatttaactgcctactggagaattgcttggtgagtggggaaaactccctgcacattttggtgatgaagtattaagtcttgaatgtgaaagaaagaaaaatagttttgtttgtgtttttatatctcatacaggcaatagaaaggaatgaatacttgtacatgttagaacatggatggaccttgaaaataagtgaaagaaaccagccatgaacatatactttacaattctatgtacatgaaaagtccagaaaaggcaaatctatgaaaacagaaagtatactagaggcttaaggctgtgggatggggaatcattataaataggcaagagatttttttgtggggtgatagtaatctttgaaaataagattgccgtaatagttgcacaactctatttatactaacacacattgaactatatccctaaaaagggtgacttttatggcatgtctgttttatctgctggtctatcttgtattttgaattcatatttttaccatgctcaattttgtaaaatcacacagtaaaaatcacttggaaaatattgatttacagagttatgcagatcctccaaatattgacacatttcattatataatataaaaataaaacttattaataacaccaccaatctcatctgaaaattctttaaatattagaaagccgtcaagtcatggtgatgaattcaagttttccaaaattcttattttctccatgaaagctcaaattttataactggcaataaatactatcaattgttttccttgaaatgatgcttcttgaaaaaatgtctgcaagataccaattctgaataactataatttcattcaagatcattcaaggaaaagcagtgtttcatgaaaaatgcagatatttctgctcacaattcaaatgatgacacaattgcttttttcctgccggcaaactttttctgtaaggaccagaaagaaaatattttaggctttgcgggctacataaggtgtctgtcaaatcttcttctttttttttttttttaacaaccttttaaaattttttcaataaaagatctcagttcaaatttgccatagaaaaacacaggcggcaggccttgccaagcctacctgtagacacccaccatactgtggtatacctaagtgctagatgtatgctttctctttggttgtatggaatattttaaaatgtgtactcaggagtcaagatatactaaaattactctctctgtttcattgaaggacattcttaagtgaaacaggcaaacaggcattgtcttctttccttttcttttcttctctctctcttttttttttctcctttgtgcgcaggcgtggtggggaagcacgcggtgccgacagatacagtttggtgccactgctttgactcatgctcagttgccagaagttccacccactattgccttggcacttctgttactcatattaacacaatgaaaaagggaaataatgtcttaggattattctgagaacagttaccttctgaaaaatctcagggaccccatggggtctgcaggtcacactttgaaaaccgctggtatagcggaggtaaaattcttcctctgccctcttaggttttccagctggtactgacataaatgagatcaaacggagaaaagcatacaaaattttttcagtagtttttttgcatatatgtgggagcccccatttttaaaaatgtgggcctagctaggtctaagtgcttatatactaggttgagcaaagaaaggcaactgcaaaaatgtaactaaaataaggcagataagaattattttaacaaggtctgtttgtacagatttctcgcctcgactgcccgtctctggtggtaagaatgtttatttcccctgctctagagagggcacctttcacctgggagttacagctcctgcttccaggaagaaaagggaaggtcagaatgctcttcttgagcctgctgtttttcaaatgcttttagcttaaaataatcaatgtgccaaagaggtggcgtgtcctgaactccttcactggccatataactttttcctattcttccctcacatcgcgttctttcatgtgaacaggcgttacataaaaataactctcagtgtgtcattgactttagttcagaaaagatctagttgggtgttactgggcaagacactcaacctttctgaatctcagtcttctcttctataaattggggaaaatcatagtacccacatatagatttttgaagattaaatgagattttaagtaaagtgcttagctgagtgcttggattagtaaatattttattgccaattatattcttcttttctttttaagttacaaattaatttcctgtgtgctgttaattatgtgcagggaagaaatatcgtagtaaaagtgaacccttttcttggtagacttttaggcactgtgaggggcaaggcagggaaacctgtttgggaggaacctaggggaagctgttcgtccacactgcaccacccagcagagcctcttagtatggcagcccttgcctctctagacctggggttcttcagatttttgagctctagaccttttgacatgtagataggattacaaagaaaattaattgtattaaaatgcagctatcaaaatatttaaaaaattgtggtatagcatgtgcttcatgattaatgcattaaattcaaatctagcagtgagtctaacaactaacacaaattggaagaaatgttgagtgaaaaggatatttcaagatattggcactgtgtataataggatataaaaatagctgtgatttttctcactgataaagtcacaggcacttctgacacttctgtgcttggttatctatattcataaataaaggatatgctacatttcaattagaggtgagtgagaataaagacgtaattttcctccccattgaagttgatagacctctctgaattctattcgcagaccccatgggggcctatgggccccaagtgaataacctctgttctatattatcttctttgcctatatttggcctttatttagaaaggatggtaaaggcagaaaaaaatgttggaaaactgtcaattgtttgatgaattttggagaagaggcaactagccaggtctggtcttttttatctggattattattattgtatgcatagtgtatttgctgaataattgctagtttcctgtctgaatttaagcttagttgactgaggtttaggaggtgggaaagctataataagcttaattacaaattataaagttgtaaatacaagccttttctgactcctcaaaaaataacctctcactttgtgggtagtttctgctctaatcatgaattgaattatacaaactatacacatgagtgattttaaatctgaactaaagtgtaaacacacacacacacacacacacacacacaccctttccacagtgtagaatcataaaatagacaaattgtttaacttccaacaccctgtctggccctaattgattcttgttacccaactgtgcgttttaacgtgttccaagtttgagaaatctaccagcactaatttgatgctgcaaatgtttatgagccttttaatgggcaaagggggattgatctaatttctcaagatggctagggaccatgttacatggcgcctgattggtgcacaggaaggaggtaagaacagtcacccataaccactgagggcaagtagggctcgctttccttccatgagatgcacatcctgatggacacaggaggtttcccagagggactttgtttagtaaggaggatgcctctttgaaggattacttcacttagagggagggctaaacacaagacttgaaataaaatgcacacacttcactataaactttctagttggtacaggaaagtttgtctttcccatccttactctcaggttaaagatgacagtatttagggaaatttctaacatatgcaggtttaaatggttaggatggaaggagctggtgcgtcatctgctcgagtggacacagcaaagaacttagagatccatgacacagtttcacagtcattcagaagaaaatctgtctgcacttggcccatgaggactggcacaatgcctgcccggtgtgtggcctcatttgccccggtttacatgtggcatactcagctggctgaccccatgcccactctgccttccttgccagctgtgaaccatgtcctctgggtccctttcaagggctgtgtgtctgctttctacttactggtccctctgctgagagcactgttcctcaagatagttgcatggcttaatgcctgattttagccaggtctctacttgcaggtgatcttcttatatgggagtgtcctcagtataaaataacagcatcttcatcatcctggccctccatataccccacttgatttgtctccatagcacttagcagtatttgacatctcccataattttatctttgcctctttatggtcagctcctcttccagaagatgctgccacttcacgaaggtagaagctttgcttattttagtcactggggtctcctcagtgcctaccaaaatgcctgggcctacagttagtcctcaataacatgtgttggctaggtgaggaaaccgcataggcaattggtgtctttatatgatagcgctagatcgcatgaaatcttacccttgaactcctaagttctaataaacaataatgtgatcgtgcaagttattcatcctctcttcacatcagtttccttgtccataaaatggagaaagttgtgtttatgcttgggaatggatagaacaagacaatgcaaggaaatgagcattgtaaactatttaacatgaagcgaactacattttagtagtatggcacaaaagcctaagaagttctgatcctatttccttctgtcatcatcatgctgtggtcccattaagcagtatcagttgccaacactgtgattgtgtgtgaagccaaggcagagacagaacaactggagctagtgatttatcttcaccaacttcgcccagcaacatcctgcctttcgtagaggacttcataaagcttttccattggcatgatctaatacgattttcacaattactctgtgaaaaaggaaaaagtgtcattgttaccattctataggaaatgaaaggcagagaagtaaagtgatttgctcagatcaacagctgatgagaggcagcataaggacaagaatttggatattccaggtctctccttatattttatggactatcttattactttgaatcaggaaaggtgtaatgtcaggctgactagtatgtcatactcataaaactcaaaactgcatacgaatttggtccagtcatgaattcttcctttctagctttaacaaaaattatgggtaagtaggaggactgctttcagcatgtctccctggagatgttgtggtcagagcccaagcacacataggcatctcaagacttgagagaaatgccaaatattctgcgtgcatccacaaggcagagaatgttgcacaatgagcttgcttggaatgtcttaaggttgacttgactattttccaaggtgagtggaaaggcaggtatatgtgaatatataatatgccacagtgaaaaccatcatccatcccatcacctttctaggattgtagaaattgtgttcacagcagggagcatattctttaaaggtagcatcatacttgtagaatagcagtataattttttacaggcataagtacaagctctcatgggatacctggattcagtgctttcttttgagagacgtgatctcacatgtgaatgtttacaaactttctttccatttcctactgccatcttaaaaagtttagttaatcctcctgattcctgattagggctatatgcttatatcatttttcttctcaatacgatagggacttgatcaatttcactgtccatgtccacagggcaatctgccctgtgtctctgatgaaactgccttgggatcaggagaggtgggtgagttcctcattcttctgagtgacagcccggacttctacagaactctcttgactgattgggaagctggaacttgaagcatctggtgcttatgtacaaaacaaacataaataagaattcatgtacaaatgtggctctaacaaatctccagcaacaagaaaagaagtagcaccaacaaatgaaaggagaaaaatcaatactaaaaggagagaaaaaagagaaacagaatcctccaaagactgtacttcaaaagtttaatttcaggctcagatacctgaccaaaagacagcatttttagtggtatctgagattcctgaaagagagtgagaaacttgttgtgaagatccaattatgacttcctgcctttgctctcccttccctctttaggagtcatgagaatacttacgcagaacaattgatgcatagagaagaaaaaaatgagtattaaaaatcactatcactaacatttattataatctaaagaagatagggttccagtcttctatcaggcccaggttcagaaatgtggtctttcttgctgtttttaatttgaataactacgtacaaattaatataactctggagtcttactccacggacgttttgacaggaaggtatacctcttactctaatgcaatggatatacatctatctagaaaaaaaagcatgtcaacaaaaaagaaagaaaatatttaacaaaataatatagagttagagatttatggcttcgaaggtgtcttcctactggttttcgttctttttatcctgtgtttgaggatgagaatgcagcaagataccttcagttgtcacgggtcgatgatcttaccctctgtgcttaccctcagattctgagagatgttttaggctgacaaataagcaaactctccaagatgtatcatattatctattgcccattagacagcagatagcctcatgcttttacaggcattggggggaacatctttatgtagtctaccttttctatccattaatctgtcaagaaggagaattagactccactggggggaccttatattacaattttaaaagtttatcatgtggatctcaaggaatagaattaggatcaacaagtagaagctaagtgagtggttaaatgataatttcagacatacagagctctcccaagtaggaaggtagggagttccctgtcactagaagtttacaaaattgagtagatcatgttgggagtcttatccttctcaccctaatatttcacacagtgcctgtcacatagcaaattctcaacaatcatttattgtccaatgaccagacaagcatttatcagggcaggagaagatgctaggttatggactagatcaatgttaaagctgcttcaatcctaagatttctatgtatattttttcagtgtgaatgttaccgtggtggagttaaaagctacttcctagacttcctctaattcttaactatttgagggatttaaaacacatttcttctcattttcattaggaagcagatatttatgagggaggcataaaaagagcttcatgggagcaggctaaaataaattatttcccagccactctgacattatctgccaactccaatgtagttgactcctagaccttgggaaccatgtttataccagtgttttcaggctgctgtgagaaacacttagcagtcccgagtgggggcgctcagcctttgttgctggttaagttttatgtggctccatctcagtacattgagacaatgaggcccttggctgtaaaacttgtaagcctagacactatttccagggagttctctgtaaccctggaaggaagaacctgatcaacggcagctataaaggagactgtaaatgaatttccccccgagtgtttgatgctttatggaaatgtgtcctgcccttttctttaattaacttttaatttctgtggcactgtaaaggagtgatggtgactgggggattgctctcagcgttctgaagcatggtatgaaaaaagtcaaagttaagtgtccacactggggacaggtggctctgctccatccagcccaccctcgttgtatcccagccaggcatcaggatgggcctttcgccacatggaagactgagcagggaatggggcaaataaacctcaaatcattactagactagaaaaaaataataataatgtaggaggggaggaacagagaagagagagagagtgaaagacagagagagtaagctttcaatgtctctaatagtgacagagtgacgggaatctctatggaagagcatataagaagtttcaggaaagctgtgttgaatgcgaatagacagaaacctgggagacaggacagagtgagagaattcagggccccttttgggaactcgaatattatccacctgaagggctcccatcctgggatcccagagaacatctgaggatcctgccagctaatccctccccatagctactgggaggaaaactgtcagtgtagtgacactatcagagatagcattccacagatttttagagagtatttgagtttgaaatgattccacagatttttaaagagtatttgagtttgaaatgtggtgctttgttctatattttctttccctaaagatgcttttcttaagctgttgttcaaaggcgtttgccatcatcatctgtaaataactgagtggcctaagcatgcggtaaatggcaatgcagggctgttctacttgcagaaattcaagtgctgactttattaggagaaaaaaaaaatcacaaataaatttaccctgggtatgaggcactgatgactaaagaaagccaccaggaatcatgccaagtaacgagctagagtcaaattacagtgatctgcttgtggcttcccagccatgagcttccccacataccttggtcccacaccaccaagggaaggaattaaagaggtgtgtatttgtggctgtgaacacatgtttgctatccatacagttatgtctttgatttctttaaaacaaaaacaaaaacaaaaaaaaaataggttttttttttttttacatttccttttatttctatatgttctttctctctcttaatgtgggtagcgattaaccaagtatataggttcacttgtgaattaacaagctatataggtccacttatagtgtgcagtgacccagaaggaatacaagctacaaaccaactctcacttgccacatgtttttgcaaatagtttcatagggacacagatttgctcaatgttttacatattttctgtagttctttttcatgctacgatggcaggttcaatagtgatgacagagaatatatagcctgcaaagcctaaaatatttattatctggtcctttacagaaaatgtttttagccctggtctatactctaaatcatcatgtctcatctgaactaattataaagattcccaaactgttcttgccctttgtctttctgacctacaatatatttttgtagggatcttcttgaaacttaattatgatcatgtcattcttcctgtcattccctacataatacaaatatacctccccccaccatgcacccaagccagcaaggcctctgcaagttcatctcttattgcttcctcttgttctcactctacttcttccaaatggactgttctcccttttcctgactccgtgttttcacaaatatgggttcatttgtttagatatgattccttctcctttttcttggatcaccactgtattagtctttctcacgctgctgataaagacatacccgagactgggcaatttacagaataaaaaggtttagctggatttacagttccacgtggctggggaagcctcacaatcatggcagaaggcaaggaggagcaagtcacgtcttacatgaatcatgaatagcagcaggcaaaaagagagcttgtgcaggaaatctcccccttataaaaccatcagatctcctgagacttattcactatcatgagaacagcacaagaaagacctgcccccatgattcaattacctcccaccaggtccctcccacaacacatgggaattcaagatgagatttgtgtggggacacagccaaaccatatcaaccacttatttgaaacccagtgcaggtacagataccttaacaatcctttgttaatctctccatgtatgtatacatctgaaactatcacacaaattcagcagaatctacaaagatgtggtcaggtacaatcggcagcattcgcctgtccttcgcagtgatgatagatttttctaacacatacagaccttctgccacaatctcaataacagtgatgagctttataaagactgatgtacttttctgaagttgttattcattcttcaacagatatcaattgatttttttttttttttggtgccaggctctgtttcagatgccaaggatacagatgttttacatgcactcacatacacacatgcgtctaaaataacaccagtgctatgtttaaacagtgactctctttcttgggtatgtatcagtttttccaaagtacccttttctagaaccgttgcatcagaatcttgctggtagaacttattttggaaaaagatttccaggtgactggatgcccaccttgaagaaccacactttaaatcccagcactttgggaggccaaggcgggtggatcacctgaggtcaggagttccagaccagcctgaccaacatgaagaaaccccattgctacttaaaaaatacaaaaaaattaactgggcatggtggcacatgactgtaatcccagctactcaggaggctgaggcaggagaatcgcttgaacccgggagacagaggttgcggtgagcctagattgtgccattgcactccagcctgggtggacaacaagagcaaaattccatctcaaaaaaaaaaaaaaagaaagaaaaaggaaccacactttaaaacagtagaagtgtaaaagaatgaaactagtctctggcaactgatttctacaaatgaatgtaatgtcttagtttaattgattcacaaatttctaaaagctaccaaagcatgacgagtttgaagtctgtctatttgggagcaagcatcttaggctgatgactgtgtgtaaatcactcaccttttctcaccttcagtgtcgtagcatcacctaacattttagggtgaatgtaaatctcatgtgtcaaatgagagggtggcggggtcatgttcaagatgggattcagctttaagtgtgtccactcttgtacaggtggctttggcagtgcgtctaaacagaaccttagcctgtgaccagggctggcatgaatccttgaatgggtatggtgagagaaatcttttccatttgtatggctaagatttgaaaatagtacctagaggagaaaaaactctgacaagcaaacattaaattgctgaactatccaacactcagttccaagtttcttaaattctggtgtcagcagggttttcccttagggctgcaagggctactgcttcctaacccggaggttaacagcagcacagaggcaaatggcttcagttctttggtcctcaaaccaagtttgtttagcccttaagctactgcgaatattgctgggaagaggggaggctgtggccagagctgctgagtaatgtggtgacagcttccctgagttcccgttaatacagatatcattccatcagcgtgaccctcagcgacctctagcaaggattaataatgaggaataattcacttgagtggaacgtgcggcgtgagaggaagacttgacaacagactcctatgggagctctaggtggctacatcggtgttggggaaggaagggggtaaagtagtaaacggggttacagaaacacacatttacatctgaaggaccttgattgagggaataaagccaatttcatgaataggaaagtggttcttgctttaatcgctgtcatttccactccatttccatggcttctgaactttcccctgtgttactgagagcctgtcacctcaaacatttaagatacaattttaagtgttctcttttcaatagcatgcagatggattgacctgggtctaactaagaccatatcttgtcctttgttgaaactattatatcaaaaggagttattcttttttttttttttttttttttttttttttgagatagagtgtcattctgtcacccaggctggagtgcaatggtacaatcttggttcactgaaacctcttgctcccaggttcaagggattctcctacctcagcttcccgaatagctggcattacaggctctcaccaccacacctggctaatttttatatttttaggagagatggggtttcaccatgttggccaggctggtctcgaactccttgacctcccaacatgctgggattacaggtgtgagccaccaggcccgtcctcaaaaggagttattctaaatggttaacatgggtgttgcctatcctcaactgaaggtagattgtatttttgagggacacacttttcttcctcccctagcccgggggaatctttgaatgttttgattgacagttacaaagaatctcatttttaacccccctgggccttggcaggcctggccctctacagtgggctagagatcatctaggtcttgaaagttcacaactgctgtttactctcctgctcctcaattagactttgtctttccattctcttctttagtgaaaggaataattagtgggggccggggggtcagtaagtgctaggtaagaaattataaacttctgcatcatattttcaaaaaggacaagagtgcggcacttcgggttgtggggagtactctcaccctagcacagtgcgaagtcttggataattgcttgcagcatttgttaatggctgctttaacggctaatgcttatagaacccttacttgtgccaggcactttataggcacgtttctccctccatttgcaaacagccttatgggataggtattctttttccctcttgaacgatgacgactctgaggttagagaagttacagaacatccctaagatcacacagcccctgagaggcagtgtcccatgtgagctcgctctggaggtccacctgggccctgggctcttctttttgccgcatctgcttccctctcactacgttcttcccttcctggcctggcgctgctgtgtggggtttttttcagcggcctcatcaacatttttctaacgagcattctccagcctctccaatggttctatttcctactgttctcctgaaaaagaattcccacccttcataaggaaaaaaggataaaattataaaagcgaatgtgaataacgttgtgtaatttcctgagcatttaaagacagattaacgcttcggattgagcaaccttgtgataataattttatgacaccctttctgtggattagggaaatgaggtttagggatgttaaaatacttgccccatgtgcccccattatcagtagcagaggactgattcaaacctatatcttttgactctaaagggctttccacccactagcagaacttcaaactcagattcctgcagggccaatatgaatgagaatgagcaaaacgggcccagtgggaactggcaagcctgggcccagcgccttccacctcagcaaaggggcagctgctttggggccccgtcagctgctgccctgggaattcggacacagggctgctgcatttttctaatatttcaaaggcaaccagaaatctgaatatttaagtaaaatgttctgatctttaaatatcggtgactacttgccatatctgaaaaacacccaggggaggccaaccctacacatgcaagctaaatgccgtcagaagttttgtgtcaggctctgtggcttccctgcctccctgtcccttcttatcctaaattgtctgatggctgctgtggcccctgttctcatgtatttttcctccactgtcctcatttctttatttttgcctcccattttcactgtaaatatccttcctgtgattttcccaggggctttctcctccccgcctggacctcctcccagcaaaccaagacactttatgatataatcacaaatggctatttacaaagccgaaggaagtcttaatgggacggaagacactctgtccacaaagcaagaaaccctccactcaggcagtcgacgaagggagagacagaattggaaatgattttatttcaattagattttaattagcttctgtcttggaaccatcagatcagttgccgaataattgaaaaagcaaccatatttgcatctgttgctcctaagaatagcaatgttgcagcatctgatccgtattttattcagagagtgagagggaggagggaagttcagtggaggaaggatttcagattaaataatcagcgtcaacaacagcagtgtggtgggtcagccctggagactgcaggaacagtcctctccagccttgtcctcatttcacgtggaattgatatggaatgggtggcaagaagcatttaattagcctcctgcacaaacttattataaagctctagcaaacctaatttaagcatgctggaaaattaaggaaagcggccattgcagccaagcgcctcccatatgggaaggagtcgcgagtttgtccttgggccctggtgttcagctttcatgcttgcggttccgatcttcaccagctccagtcaatgaagtcagggttctagcgttcccctgtcgctcctctctgccgagataaaatgtcatgcagcccgtgagtggggctcaggcctgtgtcccacctgatttcccaaggccgttccaagattctcattaccactctgctaggtctgtttttttctgacaagacaaacagggtttctaaggctatgaaggtgatgaaaatgctttccctgtggggaaatacaagtggatgtctcctctgtgaattttctgttgaggaaaatgcggtgtttgggaggctaaacagctcatgccccttgtttcctcccgaggccagttttcctgttcacgggaaagtgtattgcagagaaatattccagcaacacttttctctgttggtgtgcacttggtaatgttctagaacaaattcttaaggacctccttcctgccacaaattaacaagcatatatcggctctactgtttcccatcttcgggggtgctcagtgcctggtgctgagtcatctcctgagacaggcttcccagggagctttgctgcttcctcatagggcggcggccgtgccatgaatgactctgatctctaaacttccactctcttactttgcaaacttctgtggtgttcagctctttggcaatgggtatgcattaatgtagtccttgcacaataaaaaaataaattttaaaagtcgattttctgaaaatgaatttattatagcagcttgtgactgtgttataccatacatatatcagaaataaaattatgccagcaatgctttcaagagtcttatataataaagttattaatccattttcacaactgttagttctgtctccaacattgccattggacaggcggttcttctgtagtattgtgaattacttgtaggcaggatctgtgtcatttatccaggccaaatgtctgcttgacatacatcttttggaactacttttcttaactaccctatgtagcttagtagccctgtcaacccttactccctttagtttattccattagtttcattttcttcgcagaatatactgctattcaaatttatttatttttatttgtttattaattgccttgtttctcttgaccgttaataccatgagggcaaggaccatattacctaggccccaaatggtgcctggcccacagtaggctttaataaacatgttttgttatttagtttgtatttgctggaaacctcccatttagccagaatattttaggcatgaaaataccagagtgaacatgatggacaagtgtcttcctctcagcatgtatacaaattagtagggcaaggtgggccgtatgcaatctgtaaacaaataaataaaccagaaacatatcataaggttacataaatcctataaaggaaattaaactaggatgacgtgacagcggcctggcattgaacgtgaggccctccagccttcaaaggcaggagaagatcgagtgtttacagagaccctgagcagtgagggaggagggagggcctgtcttggtactgacccgcttagctcctgaggcttcacagtggtcctccactcagatgcccgccttcccccgccatgccctgtccatccagtctgcctcatggacgcctacttgtcttccagtcttagcactggagtcatctcctctgtggagtctttcctgtttcctctccccagggagaactgaccttggccccttgctgatgtgcacacctgtcccctgcacacctttgtatgtatgtcgttgacccatgctttttctttctctggtttgttaacatatttttcttcacctcctcttggacagtgcattcctcgaggagcaggtcctatcattttccccctatagctaggttttaggacagatgctgactgtggagtcttggttattatttgataaaccagtggctagatggaaacatgacacaatgggtccatggataagtgaaggaagtagaaggccactgaaagtctcttctcttcttaggatgtcatgattactgttttgtttgtttgtttgtttgtttgcttgtttgtttttgagatggaattttgctcttgttgcccaggctggagtgcaatggcgcgatctcggtcaccgcaacctctgcctcccagattcaagagattctcctgcctcagcctcccgagtagctgtaattacaggcatgcaccaccactcccagctaattttgtatttttagtagagacggggtttctccatgttggtcaggctggtctcgaactcccgacctcaggtgatccacccgacttggcctttcaaagtgctgggtttacaggcatgagccactgcatccagcccagaccgattactgttttaaacacttccacttctcgttttttggtctcacgcactttccctctgtgatcgttcacttgattttcttgtggctcctttggcatttacatatgtaggatcactggttatcaaatggattccaaaactacctctacatctgccttctctgatgccagcgctttcacctctccctgcccgacactcacagcaccaccccctgctcttttccgtggtctagattttccttacccattgatttttccgctggggcttaaataaatttcgtgtcttgttcagtcatgccgtacatatccttgcctctagctcacagtggttggatttatctgtcctttgatgtctgtattaatatagaacaaatattagcagataatataatggcgaccaaaagatgaaaagaggactcatgctagtgtaatattcgtaaaactcttgatttgagctgtcataatccaatgaggttaaatttatcctctagcagatgaagtaacaccagcggttcccctaaaagttgtaatattttaattattgccattaaaatctcatatgcacatatcatatacattttgaacttcagagccttaagacagttatgttatttctcagagaatcctgaggggacggaagtcacaccgggctactagagctggctcatgctgtacaaataattctctgtagaacacactctcacataacagataatgctgagcaggcagggtattatttttctaacactgatgagattctgttcagcatttttctttgtgtatttttcattatttgggaaaagccaacataatgtttatctgtggattagacaccatggatacaggtgtctaatcctgtaagcttttcagatatgtctgcctaagttccctgttgaaacatggaggccgtttatgttctcactgttaatttcgcattttgaaatacatctcttaccacctaccctgattcaggaaccagtattcagcacatggatgggcatgctgggatccaattttagagagcgaatttcttccactttccatttccaaaccaaaggatagagaacatgaaacaacaacaacaaaaatggatatttgtaagtagacagcacatgtaaaggcccacctgattattgataggaaatgaagagaaagtgatacaggacgatgttctggatttttttaagatcagatatttagtctacagtggtgtcaccatcaaagagaggtgacaaagagaagaaagaggcataagggcaccgccgttcacttggactttgacataatgcatttgagttgtatgtggccatcaaaagcaaggtggtgaaagatgtttcctgtgtgttagggcctcttctagggtccagggattcacaaataagtaaaacacaggtatcccaccatgacttgattgtaagttgggggtagagacagatgacattcccctataatgcaagaacaaatgcaaattgtaaatgctgcttggcatctagaaaaagcaaactgagaacagaaaactgtcaccactggtactgactagggagagacagactctggttctagacaactggtctcagttcattaatgtattcaggaggcattattaagtgctttctgtgtactcagtactgacttctgatttaatcataatattcctgaaagggagaatgcaattctttccactttgtaacttggtggtatttttaaggacatttctcacttcgtttgtactaaccccacacttccgcagcagtctgctgatctacagtctgctctcctgagtggatgtgcccaggagaaaggcatggccagagaatatgaaacctctctcatgccaaggaggctcttcactggcagtgaatatgccatcatgctggtttataaatctgtcttgtgtcagttaggtgggcatgaatcaatcctcctcagcctggccacctttgtggagctgatgaaatcaattttatgaccctgcagagtagaagtcctggctctggcaagctggtggtccccctcctttccatgttttttttttttttttacaaagtgccaccacccgggggacttagccttgaggggctaattgacctctccttgtaattacaaacttcacagtagcatatttacaaccccaaatgtgtctttttaatcttaatgtcattgcactgctaaatgtttcagctaccaaggtgttatgggtgaaatggtgttccccaaaaagatatgttgaagtcctacgctctcttgcctgtgaatgtgaccttatttggaaatccggtctttgcaggtgtgatcgagttaaaatgaggtcatcagggttcatcctaatccaatatggctaatacccttataagaagaagggagtttggacacagatgcacaaagagatgagaatgtcatgtgaagacacagactcagagggaagacagtctgtaaagacagaggcagatattagaactgtgctgccgcaggccaaagaaggcctggggctgtcgcatgctagaagaggcaaggagggaccctcccctagaggcttcagaggggcatggccctgccaacaccttggtttggacttctacccttcagaactgtgtgaagccatccagttgatggtgctttgtgacagcagccccaggaaatgaatacagaagcttacgcctagtattcagatgggacttagcattcgcggactggggagggagttctcccaagtctgttttcaataatattaatgtcattgcactggtaaaattttaacaaggtggtatgagtggaacaaaaaggttaaagttgaatcccaaagtccttaaaggtattttggctctatctcctctctcaataggtaattctcttcctttgcctgtttacaaagaaggcccattgctttttaaatggattataatcaaacatcagccaacttctcagaaaaggagctatgagccaaaatttaacgaccaagaaaagtaaaataacaattcattaagtctcataatctttactcaaaaattgtctataagaagggcacccataggtcaagagttagcatctcttttttgttctaaactattaatactttttgtgccagaatgaactggtgtttttgctattgcatacttcatttctctttctgattaaactcttcttccctaaactgtagttccatcctaaatgctcttactggattaccttgcctttaaatacagtgctgcgtaacgatgtttcagtcaatgatggggtgcatatatacaatggtggtcccatatgattataatggagctgaaaaattcctatggcctagtgacatcatagctattgtcatattgtaatgcaacacaccactcccatttttgtagtgatgctggtgtaaacaaatctactgtgctgccagtcttatgaagttagagcacatacaattatgtaaggcacattaagctttatagtgatgataaatgactattactggtttatgtatttacatcaccacaccttttatcattattttagagagtactctttctacttattaaaaagaagttcactgtaaaacagcctcaggcagggccttcaggaggtatctagaagaaggcattgttagcaccggagatgacagctccatgcgtgttattgcccctgaagctcttggagtgggatgagatacggaggtgaaggacagtgatagtgatcatcctgaccctgtgcaggcctcggctaatgtgcgtgtttgtgtcttagtttttaacaaaacagactaaaaagtgaaaacagagaaaatataagaagcttatagaataggatataaagaaaggaaatatatgtacagctgtgatgtacaaatttgtattttaagccgtgttattacaaaaaagttaaaaaattaaactatatatattttaaaagttacataatgcgaagattagtttattattgaagaaagaaaatttaaaaagttaaatgtagtgaagcctgagtagtgtttataaagtccccggtactaactggtaatgtccactcaccactcactgactgacttagccagagcaccttccagtcctgcaagctccattcatgttagatgttctatacaggtgtattatttaaaaaaaaatctttttatcacattttttactgtaatttttctatgtttagataagcttagttgcacaaatacttaccattgtgttacagttgcctgtaatattcagttacgtgccgtacaggcttgtagcctaggagtgacaggctctcccgtgtagcctaggtgtgcagtaggctatgccatttagtgtgtgtatgtacactctgttgagcctacaaaaagatggaatctaatgtatctcagctagtaagtgacacatgaccgtatttgaaaagtcctgctcactgcaaattgtaaaaagcatacatgattaggcatatgtatgaatcatttttttcacgtttttgtttctttgagcttttgttaaaaaagaaagcattggcttttttggaaaatctgattaatgctattgagatgtatgtgtgtgcatgtaagttgcacatcatttcagaagtctgttcatggcccagataagcagaataattgtccgtaaatgaaggatatctattctttggttggaatgaggaagtcagagaaagattctaaagtttaacatagtctaggtctctttcattatgatttgaggtttaggcttccagctttaaagaatgttggtttaaccttttcttcctttactttggactgttcgttctgtaagtttaagtacactatcatttttttttttcattaaaataaaagcaaaaaaaaaaaaagaggttgggaaggaacatgtaattagatgcttaactgccttttgatgatgctgaaggttgtagacttctgggatgtgactagggattcctttactactgaaagccttgcaggtagaaggctgtggttcaacaggaccaccagacacacagtcattctttgaaccagagttgtcatgcagcaaatgtcccacaagagaggtaagcattgtgcgatggacttgaggcatgcctgcttctccttgaagggagggtaagaggttgctggagccccagagacagcaaaagaaggaaaatgaagagggaagacaggaggtgcactgggaaagacaaagtgattgctgtttaatgaccacattttgtaagacaggacaaaaagaaaactccttgaatgacaataaagatctctattgccacaaggtttgtacagggctttctgtgcttatacaaatttgacagcctaactttaaagtgtttgaaacttgaagagagggaagaaaagggggaagagttgtgttgggggatgctgaatgggggagagggagtcaggagagagggtcaagtgaaaatgtctcgagtggtcattcctggccctattaccagttatgatggatgggtttggagaggcaggaggaagcaagtctatttaaagatggcaattaagaaaatatgtctaagtagagggaaaatggcagtgtggattctggctgttgatgtgtctgatgaagcaagactgattcacctacaaactgacacagctgcattaatgaggctgaaaatagcagttctcatcgcctgtgatggagctatggtgggggtgcctcatcacctgtgggcttatgaatgtagattattcccctttgactgaaaatcattttacctggtttcttccaagagttgaatcactgcctttcattgtctgctaaatgagcattgaaacacaaatttgttgtttggagtttggacttctgttcattgggcgatagtgagttgtattaaccttatgcttttgaaatttcctcttgtatttcatgtggatcttctttttttaatgccaagtgtaattgctgtgatttgcccaattgctttcatgtacatgtactgagacaggtttatgatactgggatatacgagtcagtgagcaaaattaagccttcattatctgagtgtatgacggtagctcagttataagaaaaaaaaaagcaggtgggagaaatttgattctgaacttaaagagaccttgcctcacatagacatattctaaatatatcctattgcatcaaaactattgaatttagttctgcttcttctgcacttcctttcctcaatattgctgaatatcaagactgctgggggaaaagagatgcattcccttgtagttttatattaaaacatatttccccttttcactttgaagaaagcacgcgtgtatgtttcttgtccttagaaaggtatgacacatgtacaatttaagggaaaagatagagaggcagaattctttagaggaaggcaaccgctcctaaacctctgctcctcctggttatgttctgcaaatgaatctctttagaaatctctctgggttctatccatgagccagcacctcctggtgttgtctgtaattgggcattatgattttagattctgatatttgcagaggaaagagcaagtagaaagaggttgatgataattgagaactgcagaaggcatcctggtgaaccgacactgcagggtagcatgtcccagtgcagggaggggctcatgctgtgagctggttaatcaaatcaaggccactgtttggtatttcacgtgctctgccagtcctaaccttacatgtcaaggcaggatgattccatttagctagagaatagagtccaacaccgctttatgggtatgttgagatgaacttatgaatcacgtacttaccatatggggaaatcaaaaagctcagagaagttggcatggtttaactttgatctctatagtaattggaagaaacaccagatgtgcagtaaccttatgggcaagtgattaaaaaacatgatataggctaaattgatgaatataaaggagcagtacatgaactggtacaaatgcaacatacccacatgaaaataatacagattgggggaaaagagtaatcccataagattctattcggctattgcaaaccagcggtgccatacacgctgacaagtccggattcattgtgctatagtaaatgctaatgtagcaattttttttctctgcctataatgtgtgggctgaaatctgggttaccaatacacaatattaaaaagtagaggtaatattaaaagtatattattaatacacagttaataacaagtatagagagatgtggaccccaaatgagaggatccaaaccatttatgagaaacacatgagaaaaatagagtctgtgaactttaattctaaaagaggaaggtttttacctgatggattttgactataaccagaaaaccaaagcaaacccccaaaaacagaaaggattctgttgaattctatcaatatgctcagtaaaagcaggcagaaatgaaggatcccattggagctgagacatgaggctgctaatgtaggccaacaccggacaggagatttagaagcatgatcttttgcccttaggtctctgaccattttgcttttcctcaggagatgagtcaagaggagaagtcagaggcccttctcaaacactgtctgcaaagggtagctcttctgtatgtacgttttcagtcttgtgctttgtactggtccttgcccgcgtttccatcttcattaattgactcattcagtaatattcacttgttcattcatgctcagtttcctcacttgtcagatagaaataatggtctctatctcagagggtttcaatatggattaaatgagttaattcctatgagacacttagcatatgataagcacctactatatcctagctgctatgatttttaaatccagtttccgtttgagttagcacagtacgatcagcatttggggttaatttggtccctccagagataccagattatacttgggttagcataaacaagtataacttggattcttctggattcttctaatactagaataaataatatcccctgactcaaaccttctgatggaagcaggcaagttttgagtaatgtgtgagttggagtaatctgtatgttgaatgtcagttctcctaatttcttgctgtgttgggaaagttatttaagttttctattcctccacactgctatctttcaaaggagaatactcttcacaaggctgctgagtggagaaaacgaggcacctactgtcttcaacatctgccacagtgtccagcccacggccagccagtgaaatcatattctctgcccagttctgcctgcctacttaggcactttttgggaaattcactgagcatcctgtcatctctcaataacacatagatcttctagacaacttcagtatcagcactggctttctttggggcaagaaagaatttttctagccaacatcggatacccaaaagtttgtcatttgcctatgacatgaggaaagaaatattaaacaataaaaaaattccactttttttttctgttggtgaacaataggataattttgttttctggttcatggagtattgttttaaaataaatagacttttttttttaaaagagctgttttagcaagattaaacagaaaatagagagagttcttacttatagcctccttcctcacacccagcctcttcctccattaacattctgcatcggtatggttcatttgttacagtcaataaaccaacattggcacatcattaacaactaaaagtccatggtttacattagggttcactcttggtgctgtgcgctcgctgggttttggcaaatgtgtaatgacatgtatctgttgttgtagtatcataccgggtggttatggccctaaagtgtcttctgtgttccacgcgctcatcccttcctgcccccaccccaactccacagatctatctactgtctctataattgtgccttttccagaatgtcatacagttgggactatatagtatatgattttcattttcacatggccttttccacttagcgacatgcatttattttttctccatgtcctttttatgtttgataactcatctcttgttagcactgaataatattccattgcctggatgtaccacaatgtatttacctatccacctattgaaggacatcttggttgtttgcgagtttgggcaattataaatgaagctgctataaaacactggtgcacaggggccaggcgcggtggctcacacctgtaatcccagcactgtgggaggccgaggcgggcagatcatgaggtcaggagatcaaaacatggtgaaaccccgtctctactaaaaatacaaaaaaaaaattcagccaggcgtggtggcatgcgcctgtagtcctagctgctggggaggctgaggcaggagaatcacttgaatgcgggaggcggaggttgcagtgatctgagatcacaccactgcactccagcctgggtgacagggagagactccatctcaacaaacaagcaaacagacaacaaaaacaacaacaacaaaagcacattggtgcacaggtttttatgtagacatgctttatcagctcattgaggtaaataccaaggagtgtgattactggattatacagtaagagtatgttaagttttgtaaaagactgtcaaattgtttcccaaaatggcagtgccattttgcattcccatcagcaatgaatgagagttcctattgttccatatctttgccagaatttggtgttgtcaatgctttgaattttagccattcaagtaggtgtgtagtgatatttcattgtttaaatttgcaactcccatgacgtatgatgtttagcattcttcatatacttatttgatatctgtagatcatatttggtggggtacctgatcttttgctcccctttaaaattgggtcaattgttttttattgttgagttttgagagtagtttttgtatctgttatgagatatatctttcatcggatatatgttttgcagacattttctcccatcctatgtcttgtcttctcattatcttggtagtttatagacctttaaaaaggcaactttctgttcttaaaaagaaacaaccatggaacaagagaaattctgatctcaaattaagttacaaagtgctaagaaggatctgatgctgatagggtagatatttggagacttactgttctatatatctgtctcccccttctcttccctttatacctatatttcttccttaggatccctggctcctggtaaaggctacttatggacactaaaagtattcagataaatactctttgtgtgtattcatacaaatgtgtcccttttcaatcctatagcttcttagagtaacagtaataacaaataccaccttctgtatgattacataccttcttatctattgccaagactcagagaaatcaggcaggactgcataagaaatcttgtggtcataatgcagtatagggtaaattaagagaattatcttttaatcagacaagtggatcactgatagctaaaaaaccttgaggcagttttggaagtgctatggccatgttacataaagtattcttttctgctctatggaataatcttgagacaggtcacatggctgttggagtgtctgaaaggtaaacagggatgcctttcacatttttttcacctctgcccctttgcatcttctcttgctgttgccattcactgggggttatttcactacttgtgttcaaaggaaactgtcaccatcccactcagactggcagactaagagttcagaagataagaaacccttcctggcatgaaatgcactgtgaaatgtatttggaaataaagtagttaatgacaattgccatcaaaaacttgctctttcaaatgcatttttcatagtttccaagccaacaggagcttgttttgtactggaatttctgatcagtggctaactgtgtgacagacaagcatgcatacttaagggtgtagaagcacacagaaaagcatacctgtgcacataattatctgtgtggaacccataactacccagactcttcacagagatggacaggacatacagtccatggaactgctacatgccaacagtagccacgtctttgcaccttgaataattgtggaaactattattctgaaagagtctggaaaagcatacaaaaccctgagtggttagggaggtagcggggttcacacatggacaaagagaaaaacacaagcaaacaaacaaataaacatcagcaggaaaagcaagagtaattgactgggcagtgaccccatcggcccaggggcatattccttagctttgtttctaggactcccaacccaaaggtgtattcccttctctactggaacttttcccttcactttgttaaactaacagacattctaccaattaataatgcatttaggttaataagcttcccctgggaatgctaaagggctaagagtcattcacacatgggtgtaaatttgtttaattagagttgtattttcaacccgccttccaagtggcaagctgaaatcctttatattgaggaaagaagaaaggccatttattgaatgtcttatacgtgccagacctggttactttacaaactttatctcattaaccttcacaatagttttccaaatatattattacctcattttcctcttgagaaaatggaggcatagatgggttcaaaaatgtgtccaatatcaccctgtcaaatggaggaggtgggatttaaaaccaggtctgtcctgttcaaatggggctttgatggaaggagtgaggtggtctcaaatatcagggcaggcatagttgagggttttcaatttgggcgatggatgcccttcaattgctgggtatctagaggctcatatatagttaggaagttagactctaagtaatgtattcatccatgtaataaacaaatgtgcattaaattaggctacgtgccaggtaattttcaaattgaggaaaacttagagatggacagaaaaggcaggtgactaccatcatgaggttcatgatctaacaaaggaagacagataataatcaaatatgtagataatttaaaagatattatgaaatcatgatgaagggtgggaataacaacatagtagagactgaagcaggtagcatgaagtgccccttttgcttgtgtatcagagaagccctctctgctctgagactttaaagacaggaggcatcttcctatgcaaagacctacctgggaggccttccagacacagagaagggagcatacaaggcctttagacaggtggataaactgaagggcttgtggtgaaagaacaggcagcaggaggaagtggtgtgagatggggtcacagagggaggaatgacaatcacagaaaggtggttgatttttttgttgttgttataattgaagtttacagccacgggaagttgtttttgaaggtgaatactcttatttttggattagaaagaccacagctgggtggggaatgtgtgaacacacaggttaaacaataggggggcagttggtgaccttgcagagccatttcagtggagaagcagagatgaagggatgatggggtgtgctcaagagaagatggattgaaagtaagtggagacaaagtgtatataaaattcttttgtgatgttttgctgtgaaacagaacaaaaaatgagatgataaaaagtgaggatgaacacagtgtgactaactgtaccgttacagtgtccaagcgagaactgaggctgacttggcttaggaagggtagcagagaggacagagggaagcagagagattctaggtgcacgttggagctgcaatgagcagagaaaactaatgaattggatgtgaagagaaaaggaaagagcgaaatatcaatggtgatgattaactttttgtctggaatggcttcaataaatggcagttgcattcagtgagagaaagaaagccagagaaggaggactagtatttttgaagaggcatgagtgatggttcagaacacaagatttttagataaaataagctaaaatgaggagatccagtaagcattcagggctgagatttaaactggaaaggctgcagcatcagtgagggagggaaagttcaatgaaggagagacgtaggtaggaaagagtttcaggattgaaccctacggcactccagcaattagacaggtgtccagcaggaagggacaggtcagtgatgaacagagcaggagccaccggtgaggtagcaggcagaacaagagagtgcatgtcagaagacatacaggctgcttttctggaagatggcatggccatccgtgtaaatgctgcgatcatgtgccacaacacacaggttaaccataggaggggagttggtgatcttgtggagccatttcagtggagaggcagagatgaagggatgatggggtgtgctcaagagaagatggattgagagtaagtggagacaaagcatatatagaattcttttgttatgttttgctgtgaaacagaacaaaaaatatgagacgataaatggagaaagcagtgagttaaagggagtgcttttgtttgtttgtttgtttgtttgttttatttataagtgaggcaccctagatgatgtttggatgctgatagggatggttccacagagaagcgtatattgatgatgctggggaaagacaggcgatggccacagcagtgaagtccctagcaggcaggcaagagggttggaatctagggtgcaggaaaaggtgctagccaccaatagtggttgagagacatcaacttttttagcaagtgggaggaaggggtgtgaggacaggtgcggatagtttcctaaatacattagtgggaagaagaggttgtcccccatgcgaaggcatgttctcaagagcttatgaaatgaggttctactgggaaggaagggatggcaagacgtgtggaggtgtgcagatttgaggaagctaggagaaaaaaatggaacagggacaggggaagaaaacaagcaaacatactaggaaattatagcaggatggccaggtagactcaggtgccctctgaagtcctaaaagtaaggtaaggtattcttttgagataattggcatgcaatataatctatgaagaaatacattcaaagattaaagtctgatttaccacttacatatattgtttaataacaatgaatattcataaagtgcactttgcatgcattatttcatttcatccttacaaatacatgaggtggatatgattatagtcttcatttacaaatgaggtaattgagacttggagaagtgaagtaagcttcataaggtcccacagctagtaaattagtcagaaagggtagaaaccagtctacttaatgacaaagactgtgaccttacacctccatgctgagctgctcctcaggttacaactgagctgtgggtgtgaacatatgcatgcagtacttttatataattaaaaatctcagctgcatatcacaagtaatgttaaggaaagggagggacttatttttggtttttgtctgtttccctccaccatcagtgttccagtactgtttccttgggtcaccagggaagggaagaaagctgactggaccatcccctgggccagaactgcttttgcatgtgacagtgcatgagtgtgtgcgcgcacacacacacacacacacacttcactctcctgtcagctgtcacagttgaaaagcctttctcttatatttctccttgtaatccattcaccgcctcagagactcctggtttctcaggggaatgtcaccgagtgcagagttttgcatctatttctagaagttattcatgcatttacaaatggtggaaagaaatatggaaccacttctttttgtggggacacttgagagtactgatgactctggcaagcggtggggggaggtgggagagggagagtgaggagggcctatacgatcatggagggccttcaaacaggctctctccatcttccacattggaaggtggccctgcacaccagctgtgtagtcttagctctagtggagtcccagggagtgtatcacgggtgtctccagtcactgccctgagccaggcttgctggtctgaggatagaaagtaagcaagggaaggcaagtaagagacaagactccttttgtttattctgtgttttaataattggctgattacgttccatttttatttggtttcactggcaatcagatagagagctgtaatatccactcacaccttgtaattaccattaatttcttccctttactctgcagagtcaagacaaggttggcagagaagccatgggagattgaatccaaccgagtgcaatgcatatgcatgaggcaggacccaccaaggctcccaggagacatttagtggggaggggtgagaaggggaggaaggggaggaaaggaagaaggctggaagatggaaagaggggggaagataccttgaattggaaacaaaggcaaatggaagaaagtgtcgaagtcagcacaacagccttgctagcttaattaccataatgatgtaaaatagtccaatcagcaatctggggctaatctttcatgtattacaggtctctccttcgtagagcttcacagcttaaatgcatttttaatgaagatatttgaggcaagcggataattttccagtctttccaggagggaatcagagcacattaaatgggctgtttctcttccctgtagctgcccagagttcttgctttgcctggcacatggagctggttgtctttcagaataggtggctctggtctctgccctccttccagaggcagctggggaaggcatggatagggctgacatccagggagagctgtggctggttgaaaggagcctgtgctctgccttgccttgtgcctaggggatgtctggatctccttgctagaaatgagagaggaagggccccagggacattccccagccctgatgttatctcagctagcaggagaatctcagcttcgttctgccagtgtcatgctaacagtccaaacaccactggagatgcatatgaatctcttacttatgacacatacatttgcatgctagagtcagcaaaagaacagtcctggcctcttgacctcactcctctaaccagagaaggctttccttgtggttccatcacccaaggactctgtctatggtacattcaagtgatgcacaattagatccattgaaaaagagcagtctttttgtttgatgcctaatgctgtatgatgggggaagactaaaatatctgggttaaacatacatgctatgtatctataataaggccccctctcagagggacaagttttcggggaggaggtgcggggaaagaaagtacaagctacagattgtatatcctggtaaggcaaaaacaggttaaaaatctcttagactgtggtttgggggaagctttaattattctattgctggtgtttccttctgtcaccaaactgcctgagatacagcttcaactgtttagatatgtgcagtgaattcagcaatttctggaaattctgtctttacctttcttcccaccagcacatcccatcaaactccttgatttccgatggcacacatcttctccctgaatgagggtaaggccaaggggcttgcagcacttcacaatatgtttttcaaaaacagaatacacacacacacacacatacacacacaccacatatatatgtgtatataaacacaaacataaatatataagtccttagttttcttgaagttggaacttgatcgaatgtctgtctagctgtttgtaatacgcctatcactggcctgctcagacactgggcagcctcactaaatctaacctcaaatacctacatatggaataataaatgctttggcttcttttccttcctttgtggttgacagaatgagaaggtgggtagtaagatcttatagtaataggattatcaggacttgcatgtgaaagcaggacccccattaactagaggttaatgaccttacttttacgggctcctaagaacccaagacggcaggaaggagattcaaatcccacactccattttcttttcttcctttctggtttctttcattcattcattcattcattcattcattcattcattcattcagtttttgctgtgttaaggctatatgtaagaccctctgacgtttccagagtgaagatgcagacagggaaggcactggatggagatgaggaatagaagcattcagagcctccagccccaggaccctgggggagaaggcacatcattaaaggaagccctgccgcattctgactctagagcatcacaaacagcacagcagcctccacttacaaacatgtgttttttagcgagctgtttggttggttatctggagaaaagtatacttaaagtgacttactgatgatgtctcttgttgtatttcttgagggaaatatagataattgagagaagaaaagcaaaactccctcatcctacaactcagaaataaatattgatatcatatgtctagacaaatatattgtgtcataacaaaaaatgggagaatcctgtataattatttgtaatggcagcatgttgaatagcattaaaatattcattcctcccagttttttaatttggctatgatctattggcctatcttccaggttgataattctgtgtccaactgctattaaattcatctattgggttaatgatttcagatattgtgtcttttaattctggaatttctatgcaattttttaaaaataaattcaaacactctgttaaaattcttcatttatatatacatctatttcatccattttgtctctctctccttttttttttttaaccaaagtaatcatagtcatttaaagtctttgtctgctaactccaatataggtatcatattatggtctgcttcaatatcttttcccctgttcaattatcagtcatatttccttgcttctagtgaccttgtagtacataccagacattgcatataaaggaatcataaagctacagatattatttttctctagagatccctcctattccttctggtatgcacaaaatttctggcattaaaaaatactagatgtgtgaaaaggcaaggaaatatgactgataatccatacatagcacacaaaataatagaagtagacccatatatggttcttttttttttttttcgactttgtaactttacttcatcctcttcatttacatagggtgtgccccaagtagagggtatttatttatttattattattttttattatactttaagttttagggtacatgtgcacaacatgcaggtttgttacacatgtatacatgtgccattttggtgtgctgcacccattaacttgtcatttaacattaggtatatctcctaatgctatgcctcccccctcccccatatatggttcttatattggatttggcaggcaaggactttgaaataactataattaacacatgtattagtaaggttctccagaaaacagaaacaatatgattttatatataatataatctgtctatatatatatatacactcatatctatctatgtgtttatctatctatctatcatctatctatctatctatctaagagagagagaggttttagggaattggctcacacggcgagcaagactggcaagtccaagtctgcagggtgggcggcaggctggagacatggaaaaagctgatgctgcagttcaagtgcaaaggccatgtgctgacagcatgccctcttgcgctagatcgtgagtcttttgttttattcaggggttcaactgattacaggaagtccacccacgttacggagggcagtcgactttgctcaaagcccactgatttaaatgtgttgttgatgtatacaattaattaccccaaattgaagaaaagataaaatagaagaaaatagaataaaaaattgataaagtaaatgaaaggatggaaaatttcaatagaaaattgaaatctaggaaatgaatcaaggatcttctctacttccaggctcagtatttctacagttgtttcatctgtgaatggttggaccctggcacctcttttgctagttcccagtatagccccagattgtcagtgaggctccatcatgaagtgtctgttctcaggtctgtgggattctatccaggtttatgctttctaaacacggtctgtagctgtctatctcctcttctatcagatgtcaacttagaatgagtttctcccttgtacaatgccatattgtggtcactacttcataacgtcttggtgatacttaaaatattttgttttatttctttaaagtttaaggtttatattgtatattataaatactcttcgcattgatatatagacttccgtagccataagtatttcatcctgataagtactaggctcttcttccattacattttttttttggcgggggaggggggcagttacaaggcactcattacagtctaaatatatagatttatctaatccctcccttttgcctctaaaatttaaattcaaagccctcctggtaaagctgagttttctcctgccaagttcattattctatttcagggaattatgagatgttctctgcccttgttatgagatcacctctgaagcataggcatatatccagaaaaacaaaccttattttcctttagtatcagctacatagccagctgtctgcttcacacatccctttaaaaattttttttccaaagacaaaaaaagaagccatgaaaacacctgtggtcccaagtccttcagtttcatacctaagactacagggtcaatagagatacaaagaaaatttatttggaatattatattaataaaattgtatatactggccttcactggtttgtagacttgagttttagagaaatactcctttttcagagtgtatcatcttcaaaagtaaagcactatcccagcaagcaacacccccaccccagtcatctgaaactccctgtgtatgacatgatattttttctttaagattgaatatgaaagcctcaaccatcacatcaagccacagatcaatcatagccaccacacagagaaaattaccatttggcaacatccatcatctttacaagtgctacccacatctaactccacctgagccatcattgttgccgcttacttctatcttcagtgaggctggaagtcaacaaaagggtcttattccctttattgggagaggagaggagagtagcacagaaacgcctttctgaggggtaactgtctttccaatcctggattcccttgttgtcaactccctcttcacgcctcattttatgaaatcaataaagaactgaagctcttcttgtttatttgtcgactatacccttctccctcttgtacaactgattttgaaaaagaaggatatggctgtggagagaagagttgttatctctatcctaaaatgaacaagagaagcaggctacacatctgtgttgtatttgagtcatgaaaatgcagtcccacaacggaccaaaaactctctcagaactctcgaacgctgtgattctcagttttcttcttctctcatgagtaatagccttgttccctgaacacccaggtgtcacgtatctcttcctgctataaacaagaaatcttacctgcagttggaggtaaatgcccacttcttgtttttgtataacacataaaataagaatgtttttgtacttaaaaaagcattttaaatggttgaaaacaaatcacaagaagaatatttcataatgcataaaatcatataaaatttaaatttcagtgtctgtaaataaagttttattggtacacagtcacattcacttacataatgcctcggagatatttttaaatggcaaaattgagtatttgcaacagagaccatatgcccctcaaagccaaaggatttattatctggccctttacaaaaacagtttgccaagctgtttcaaagcagaaactgacctaagagagactgcttgtctatgatcatgttaaaccacaatgccatgaagttggaatcagtatcatcctacgtgatttttcatgctgcttagaaagcctctgagtctttagtccaatattactcttatttccagcacagctatcgcaaacatgtccatttcctcaagactccaacttgcccttgccacttttcacagtcccaccagctgatttcatgtcctattttatgtagagaaaaattaggccaataagtgtgaactgcctccagctgctgcttcttgcctgccttcctctgcatctagcacccatcttatcttccttgtgcacatctctgctttgcagcaagacacatttctctatctgtgtctgttgcattcttcttcaggatttcatgccatccagtatctctttcttcttctagatcttcaaccttgactggctttaataaattttgtcacaacatataaacatgagtttttgaagaaaataaatcaatgaataagaattttaaaaccatctcaaccccatgtcctcctttggggaccctcctatggggggtcacaataatctccctcattctcctcacacctaacctactggaaagagtactctgtattcactcttcttaactgtcactgtcacttctcaactcacacaaacctaacatgaaagggcataaagtattttgggggaaaataatctaaggtagacaggaagagtcagggccaaacagaccttaaattcctttgctaaagacttcaaacttaacgccaagagcgaagggcacccattgaaacatctccacacatctttaatctattatttttgtctgatgtattacatgtttgtgtagccccttcccatcctcacgtacttcacaggaggtccctgccatctgaattacagtagagaattctgcaaatattcagcgggctgacaggtcaagatgcggaggagacttctattctcatagcaagacttaaaagtccaggtaggtcatcaaaaagggaaaggcataatccgatagacgttttagaaaggtgactcatggaagaatgagaaatggatttaatctggtgaatttggacgcaaaaagatgagttaagaaactattaaaatagtccatgtggggcaaaggcttcaactttacagcaaagggttttatgggggtcacgaaaatcaggtaagaaatgaaactaagctctttggggaaagatggcttttaagttcacaataaagacctcacggtgatttactgtaacttattttttttctaaaggagtcatattccactgagatcagaacacttatgagtgactgtgtgctattgtaggaagtgtatttaggacccacttcatccacactaatgagaacacttgcctcttgtgagctgcttccacaagaatcttctatttcattggagtctgaagtctgaaatcctaattcctccacagccccccatagcaaattcccattacaataaactccatgaggctatgtgtgatggttaattttttacatgtcaacgtgactgggtcatggagtgctcagattaaacattatttttgagtgggtctgtgaaagtgtctcaggatgagattagcatttgaattggtggactgcggactcattaaactagaatgccctttttaatatgagtagtcacaatccagtctattgagggcctggatagaacaaaaggcagaggaagaaggaatttgcccttcctcatgttttcatttctgcctcactgcctgaactgggacatctcatttcatcagcttctgcccttgggctgggatttacatcattggctcccctaattctcaggcctttgcactggactgaattataccactggttttcctggggctccagcttgtacttggcagattatgaagtttctcagcctccataaccgtatgagccaatttctcataataaatacatctctatctctatctataatctcctattagttctgtttctctgaagaaccttgactgaaacagcagacaatgagttcaactcatcactctccagttcctcgtacatatcacttgctacgtagtagaattcaacagtattttgaatgaatgaatgagcaaagaaacctgtgaacttggaagtgactgctgtcattcatccatcattcactagttatttactaaacacatactttgtgatcagaactgttctagacattgggatttcagtgtgaaaaggataactttgaggcaaccactaaagaggtgattgtgaaggcgatggacacgttatttgaaaaggtgttattagtgcatgtaaaacgcacacctatctcagacaagggtgaggaatgctggcttccaaaatgagattccatttaagctgaggctgagggcaaacagtaattatcccagggaaggtaggatgggggagagcaatacaccgggggaagcagctgagatgagaattaaggtaggagtttcacaggttaaagtagttcaaggttggcagaaggaagagcttacagaggcaatgatgagggataaagctggacaaaaaacagtggataaaggatatctataatgaggggtttggacttgatgctggggatgcacagtgctgcatctttaaagaggttctctccaattaagatagaagtcagctaagagtgagatttaagatggggatacagaagagaggagaaggttgctgctgcaggctgtggcaccgtggtgctgatgatgggggctgcttctcttgcattggtagtgtccatcatgcagtaaaatgacggttatggtgctcaggttctaccattgtgctggtacttctgcagaattaaaggaacttttgtgaactcattttgaaaattaaacaaccctcttaataaactcttttgacggaaaaatatgttgagacttctaattatcgctgtaaagactgacttcagtaatgctgcctagttataattgagacactgtttccatatatgagttctttaaaagagatatgcagatggacatgatctttgagctgtaaaaagtctgaaccaggatatcctgaagatatcatcaaaatataaagttatctaaaaaaaatgtgtactgagttcacagaaattaaattcaaaagcaatgaaattattaaaaaagagaacctatttgaatcaaaagggaatattttattgatttttattgagttttattttaaattaacttgaaagtttataagttttacagaactgctcagtgttttcagggaggtctcatttagtaaatcatagctgtacaaacctcaagttataggacctctgtatagatctaattcatcttgctttcaatgaatattttttgaggacatattatgtggaaatcactgtattaagtgctagggagatacagaaaagtactagtaaaagcaggctcctgccctcaaggagaatttaagttggtgaggaagatatacacaaaatgataactaataccacaatctatgtaataacagagtaggagatgaattagtgataagataatcaagatcattgtagttccaaagagcaggcaattaaatgtagctggaagtagaatatttgctgagttctcaatgttggatccacttttaatagacagataaaagaagggagcagaccatctggttttctgcttcatcatgctattgaaactacactttaaaacatttccaataacctcctaattgctgtctctaatagtcttgcctcagctttcagttcatatcctctttgcagtgcttgattttaaaactttctccctcttgattctgtaatgttaattttctgagtgtcaacgctatttctttggttcaattttcttcctctgtagggtaggttaggagcatttatcgcaaaagattatatcattccttttttctactttttattgccacctgttgctcaggttcacctttcagacacagggagtaaaattgaggaaactgatctatactttgcaatgcgcagtgtaaatgtcttccttcttggaagatggaagtttagtgctcttcatccctggccactcagggaagggcctggccatgaatgtgctccttccctgtcccatttagtccttaatgttgtgattctctaaggttgggttaaaaggacccctgaagaagctggtgcacagttagcaatgagaaaagttaggctaaaatgctgggggatccagactgtccaggtattttatgctgcaagccactgcgtctaagctggagaaataaactaagaggtacaagagatgaccacatcactgtatatattaatataatttgaggataagcaacacactgttctgcgattatgttcatttagtcctgtgaacaagctgatgctctaatccgtctgcctattgatggagcgctaggctcttcacacccatggatggtttttatgcttttaaactagggtatgattgtgttgctgtttctgcgtttgaacccttagtgagcagtgacctttccagtctctgagtgattaaggctcttattaatttcctgtggggttgccgacactctaaggcagcaggctgttgggggttcattaacatgtggggctctaattagcggcataggatctgtctctgttctcactccgatatggaacaaagctataaatatagacacataagaaaaaatacacaaaaccgtaaccgaaagaaagaggtgttgacatgtccagggcagatctttaaaccaaaacagccactttcccggggcctaatcaggctcttctagaaaactgcatctggatgggatggcacagtatgggagaaaatctgagggggtctagatcagccttggaaataattattgattgagttatattgttaactcccttctgcacctgtgattcaatgaattgcaactctaaagaaaggtgaaaagaattgaaatcccttgatgctgagaagagaagtaagagggatttaataataatcgttatgtctgggcaggattttaatggagagaataatgaccacattccctgtttcccaacctagagacgaaatgagttcaaattgcagctgggagcagtttgattggttaattaatattttgggggcccttacaagatactaaaccctttgcaaggagcttgtaggtagttagtgcacagctcttggggggcacctaaaaatgtgccagatgttgcttatgaaattctctgacactgacagtgaaccgatcaggttaggcttcaggaagcattctgcaaattgttacacactggactgaatgcccaagaaggggatgtgttatccccacccacccagcacctgaagatctttataaacaggaaagaaattcattaaactgaggtcaaggagctggcctgaactgagagggagaatgggcggtataaagactcagcccttaatatggtaacaggaaacccttttccttcctctacccttaggtgctatgcgtttgaggtgcccagaggaaacattttgaaggtacagccgttaagttccattttcaacatcactctttggtattttcttatttatttatttttgagatggagtctcgctccatcaaccaggctggagtgcaatggcacgatctcagctcactgcaatctccacctcccaggttcaagtgattctcctgcctcagcctcctgagtagcagggattataggcactcgccaccacacccagctaatttttgtatttttagtagagaaggggtttcaccatgttggtcaggctagtctctaactcctgacctcgtgatcctcccaaagtgctgggattacaggcgtgagccaccgtgccctgcctggtatttgcttctgatctgagtctagacatgctggtgcttggaagtttccatcactataacccttcttttctttccacctgtatccacctaggcaaggtttccctgggagtgggaattgtgaacatctaacagaaaggatgcccagagcagaatgagacttgaagtctgacctgccctttcatgtccacgattccatggtttcctttcaggcaggtatggctgcctacacaaagatgtggcccttggaaggctagctcagaagacggagggagaggctgggtgtggtggctcacgcctctaatcccagcactttgggaggctgaggcgggcggatcacgaggttaggacttcgagtccatcctggccaacatggtgaaatcccgtctctactaaaaatacaaaaaattagccgggcgtggtggcgggcgcctgtagtcccggctactcgggaggctgaggcaggagaatggcgtgaacccgggaggcggagcctgcagtgagccgagatcgcgccactgcactccagcctggcgacagagcaagataccgtctcaaaaataaaaataaaataaataagtacataaataaacaagaagaagatggagggagagaaacctgcagcactgtaagaggtggcgtcttggccaagccacattcagatcagtgtgtgaagtgggggtgaatgtgaactattcagagaccaattctcatagaatttaacataaatcataaataaacacttggagatggcactttttttaattaaaatttttagttttttaagatggcattttaaataaatgagctatcagtgtattatgcttactggagactccagtcttttattaaccctggggaacatttagaaatacaatattaaaaatgttgttaagatttataatctatagtaaggaacattaaaaataagctccgtacacccacatgaacttaaataaaatcatcctggttcagcacttagcacttggcctggcacaaagcacagtggtaactgtagctcggagctgctttgtccaaatgaggttcctaagtcagccctggagtatggggggaactgaggtttggattatctacttccttcacacttgtgctcactgctctcctctgtcttcccacctcatttcgctatttccctgctgttaacaccacgatcatagtggcccagggaaatgaatgggaaatgagccacgtatgctgcttcttagcgtcagcgaatggtttagtaagtaaggtggttagcattatggaagaaaattaactcagcattaatttttgctgcttctgtttttccttttaaatcctgagtgagtgccactttctttaagatctctagacagcttatttcttggagtatagccttccagaagctgtcagtggggtaaaaacaagcaaacttttaaaaagcaacccccccgcccccaccgaccaaattttaaaaaagcaaagcttttcttttggggcttttagaataacaaaggtctgaattatgtttgtatctgaaactaaaagctttcagcagctcagcaccatcctttggccagaggtcctggttatcactaagagaccttctccatgcaggtttgagagcctattaataggataatcaatgatgtgttactgctttttaggagaattactttcagctctgaaatcctgtgtagtttgccaagagaaattcagtacaatcccaaattgcttcaaacctgtttcaataattagcagcaagtaggtgaaggaaaagataaggcaaggaaagacgacagtcatacccgctcacagtcgtgtttcatttacactaactaggaaagtggaagcttcatcacagggttatacccaatgatcatcaaatttctttgggaaaaaaatgtgttaacccttcaggatcaagcctccagccttcactgcgtttaccatgatcccacacagtgctctgccccctccactgtgcttttaacattttagatgtatcaatctcttcaaatttccctgaccagtaatgctttcttgtagcactgtgcatttgcacattctgttcccactgccaggaatttctttcaggcaggtcttcctgctgaacgctctcacactgcgcatcaagacagaccaggcagggatttctcacttacattcccaccgtgctatagtgtctcaacatcccgcagtcggagctttattacattgccttgtaatcacatgtggacatgttggcctaccttctctaagctgtgaaccttattaggtagagaactgtgtttggttcccatcccctagtataaaattgaaccaaatgaaattgctgatatttgactttttaaatctagagctagctatatgatacagcaatttcatgtagcttgatcaaattcattgccagcagaaagaacggttaaaaatatctctcttgaaagaaagaaagatctacatttactcatgtaatacgtgatttctttcattgtaatatctttgcccagattacaaatcagaattttgatggccttacaaataagttgggaagaatttcctcttcaggctagagtttgcttgagagtggtattaatccatccttgaatgaatgatagaatgtaccagagatttataaattctatccctttgattgatacgggtttagctgggagtggaaattctgagcatctaacagaaaagagtcccagagaagaatggtacttgcagtctgacctcccgttttatagctatgattccttgatttcccttcaggcatgtctggctggctacacaaagatatggtcactggaaggctattcagagatggagggagaggaatccacagcactttaagagctgcttcttggccagccccattcagaaccagtatgtgtgaagtggagatgaatgaatactagaatttacccgtggatttataaattttattctttgaagtgaaatgggacttacagatttttttatagaatgcatttctcaaggaactttttgatttttagtaatatcagagttgtcaagttcatggggataacttattaatgctatttccctgttttccttttaatatttgggagatctctagtgatagactcatgtttattcttcatgttggtaatttggccttctttgcttaatcatgattattctttttagggattttggtaaattgtattcgtatttccaaaaaaaccaagtttgagacgtaggttttctctattgtgtgttttctagttcattgggttttgctcttatgtttgttgtttctttgtgtctatataactaggatttagatttttcttctttatctacttacagtggaaatgtagatttttattttattgtaagtcttcttttctaatacaggcatttcaaaactatacatttctctgcgagcattccgttaggggcatctctaacattttgatatatttcattactattccattttaaatatttgcattttttgtgacttctcctttgatccatgagttatttagaaatgtgtgcttttttgttgcttgtaatttccaattcaggctttaaattgtattcagacttgttctaaggccaaggataatggtatatattggtgaatagcttatatacatttgaaaagaatgtgtatgatggcactgttgggtgtagtgtcctgtaaatattgattagatcaagttggttgacaaccatgtttagatcttacattttcttcctcatatttgcctacatttctagcaattactgagtgagtggaattaaaatatccaactttagttgtagatttgtctatttcttcagtcaattttgtcagtttttgctttatggattttgatactctgttactaggtgaatacatatttaagattagcatgccttgtgggtaatttgctcttttatcatgcactatttcacatgatctcttgtaatatactttttcctgatttctactttgtttgatatcaataaacccacatcaactttcttatgcttgcagcttgcatgttatatcttctctcatccttttaaacttgtctatttctttatatttaaagtgtgtcttatgtagacagctaacagttgtgttgtgtttttctatccagtctgttagtctatgccttttaattggcattttaaatcccttcacatttcatgtaattattgttttggtttgatttaagtctaccatatggcaatttggttttttgtttgtatgttttatcttttgttgttttctggttttcccttcccagcctcctatgttaatccagtatttttagattgccaatttatttcttctattaacttcttagctataactctttttattaaaatttttatatggtttctctatggctaatgatatgtaaccttctccttcacatttcacacccaacactttctgattctcgcttcctattgtctattttatgtttacctgtccttgttttctgtgtgattattgtcatataatttgcattttcatatgttttgaattccatcttatactgttattatttttgctataaatagcagtttttaaagtaaattttgaaaagtaaacatactcatttatatttacccacatatttatcatttttacctatagatctgagtttccatctggcatcattttcctttgaattgagaaatatcttttttaatttcttacagtgaaaatctgctgtcaacaaattttctaagccttcatttatagaaaaggtctttattgcactcttgcctgtgaaacttttgctggctgtagaatttctgggctgactgtttccctttctttctagcaatctggagaggttgttccactgtctttcctcctctattgctctgatgagaagtcagagtgttgctattgctgttgtctctattcaatgtgctctttttatttggttttcaacagttagattatgatgtgcctaggtgtggttctctttatatttattctgtttcatgtttgctggacttctgggatcaataggttggtctggtttcttaaataaaatgtgggaagctctctgccactgtatcttaaaatatttgcacaatgtcactctcttcttcttcttaggcaccaattgcacaaaaagtaaatcatttaatagcattctgtatttccctgaggctcataaaatccttttttcttctcttaaaattgcataaaatccttttttcttctcttaaaattgcataatttctatttatctgacttcaaaatcactggctttttaatgccatcttgaatatgctaatgagtccatccagttagtttctcatttaagctgtgtacttcccagttctagaatttcatttggttctgtttctatcgtttcaatttctatgtcaagattatctctgttcattcatttagatcatattttcctataattttgtgaacacatttttatttaattctttgactatatttataatggctgctttaaatatttgtctgctaactctaacatctgggttcagtgtctattggtggattttattcttaaggctagatcacagttttctctttctttttaggactattgattttttgttgaatattggcattatagataatacagtatacagtctctagattctgttaccttactctaaagactattgatccttgttttaacaagcagctcaattactggctgatcacactggtctaactagccaaggtccagcttgggatccacattggatcttgtcagggcttcgtttgaggcttttctagagagagtttagcataagtcgtgctctatttctagtcattacaccataggaccaccattttggtctctcaactagacttcgtgtgctaaggggtagatctcatcattctagcggggcctaaatttcaaaatctccaggcactgcattttccccagcagtgcatttagtagctatgttctgcttttaattacatagcagctgccacctggtaaactgcttgtcttgctcagtgggggactccctcagccacagacttgcaggggcctcccagagcatcttgtgaggcttccttttcacagttgcctcctctctagtttgccaccttgtaaattctagaatctccagctgctttgaaatatgatttttccacttgggctccgcagaaacatagtactctgctttaactccgacttcatgcaatgtggttgggaaactgtctccaggtagaaacccggcgaattgtggggctcaccttgctttgactctgacttcctgcaatgtggttgggaaactgtctccaggtagaaacctggcgaactgtggggctcaccttctatcagccatttcagtcttgtgttgcctgctctttactgaccgaagacaattatatttgatattttaaagctgtttatggccaaggtctattccaatacagttactccattgtggcttaaagtgaaaattatttatgtaatgtgtctcaaggattcttatcaggaataataacgtttcttcttagcaagcatcctaaataagaacagttaatagtgagcatggcttactatatgccaagcattgttttgaatgccttacatattaaactcatttaattcttacaacagcactctaatttaggtactatccctatttttaagtagaaaaattgacacacagattaattgaatgcctaagtttatatatctataaagttattgagtcactaggtagttttagctcctataccttaacaactatactatgctaccttctggtggaaagtgggtagtgactaagcaaggggaaatgatcacaagaaggagcacatcctcgctcattagtgaaggatgagtgttccgagtattccaagttgaatcatagtgagtttgggctttaggcctctggttccctcccaccatgtcccatcaattttacctcattccaccaggaggttttaatattcaccattaagtactacagaggtgcagaaaaagtggtgggaatggtagtgggattcattcttatttttatccccatccttacccactgtattctttttcttagtttggatgtgagctcataaaatgtgccaccaaaagaagctcgtttaaaattgaaagctttgggtggaataatatatgctagaatggccatttgatctatctgtgacaagtgctaaaacacatgtgcattgattttcttcaaggagcgtatttctaagggtaatttaatagtagtattgagcatagcttttactggtggggaggaggaggggagaacagatgaagagagggagctgctaatggcgttttcctaatgcatttgcttaggtcagtggaaacctgtcacagcttaatgcacttgctttttgaggatgttatcgtgtccaggattaaaccattccaaaacatgaaaacgacagttgcttgttagagtgggagcttgttaaagaccttctatcaagcagttatgatcatctgaagaaagaagttatggttcttatttttctacctttaattctaagtgaagtctaagtactaggaagaaaaaagcatttaattttccaaagaggatggggaatagcacaataaattgcttcaaagacccctttctttcttttcccatctacctacagaaatcagacttcatttctagaggaaattcagggatttttgctctactatggccctggaaactggagaaaatttaatctctgacatggctttgacttcacgcacttttctggtactcaggataggaacatagacccttcactgaaatcacatctaatgcctagagtcgtccagtgaatattctgtggtacagtattttctaattttttttgcatatttctgctgttggtatttgttatgttcagaatttgtagttcagaaaaacctctctaaaagggagagatgttgtaactggatcacaaagaaggtgtcagaaattgtttctaagaaatctttaaggatttgttctccattcatgtcttgaaccaacgttgatggagtaccagaaggctagtgagcatagaccaggctgagcaaagggtgattcatgatgcagctggataggcaagcaagggccgagtaaccaagtctgttcagggacttcagagttgatgttaagtacaataagaagccacggaaatgcttgtggggaagggttggcatgatctggttttccttaagtaaagctcacttcagatcctgggtaaaaaatggactgtgtgctgggggaaggaggagaaagagttaagagggtagagatggtgacggtttgtgctaatgaaggtgcaaagaagagaacttattcgaggtaacagtttgagtcagaagcataagattttctgatggtcaaaaagaaaagggagtagcccaaaatgattttggcttgaacttcatgactgttggtgctatttacttagatggtgaaggctgggttcgggatgatgagggtggtggggggagatgacaattctggtgggagagaaatcaagagcagcatttgggaaatattagttttgaaatgcctcagaaacatctaaagaggaatgttcaaagtcgaaaatttgatttaattcaaaatgtaattgctttgagggcagacattatctttcataataagcacatagaatactgtatggcacataatagcactcaataaagatttcctgaattcatgagcctagagctcggagaatagactgagacttaacctgagaggcataagcaggtagaagcgattttaaacacaaaaatggaaaagctcaagataaaataaatttatatacccatctcagtttcttctctgtcaaaagcagtttaaaataatagtttcagagatttcttttagtactaatattcaatgcaatttatttgtttggtttgaaaagtttcttagaattatagaaagaaatagatgacttagcatttgttttatttaaatatacctggaattggttccatctcattctggtgtgtagtgagatgttgagagggctggtataccattctggaagaccttgtattctctccaggcatgagtctgtaggatctttcacagtgctggtaaaaaagtcataaaatggaagtctgtgtcaaaattatttctaaaataaaagtaccaattggttctttaaaaatatcaacaaaattgacaagcctttagctagactgggaaagagaagactcaaattaccaaaatcagaaatgaaagaaggtatattactacttaccttacagaaataacaggattataagaaactataatgaataactgtatgcctacaaaatagataacaggttaaatgggcaaattcccagaaagatgcacactgcaaaaactgactaaagaagaaattaaaaatttgagtagacctatacaaagtaaataagttgaattagtaatctaaaaactatccatagggaaaagcccatgccccggtggctttactggtgaattgtttcatttaaaggagaaataatatcaattcttcacaagcttttttataaaatggaagatcagagaatactttccaacttattctatcatgtaattattactctaacaccaaaaaaggcaagtacatcacatgtaaaaaactacaggaaaatattttatgggtattagatcagaaacttttaaaaatgcaaccaagtgaaatacagtgatatataaaaaaggattatacatcatgactaaatacaatttgtcccaagcatgaaaggtaaacgtcttaaaatcaattaatgtaatccaccattttaatagagtaatagacaaaatctatttaatcatttcattagtaaggcaaaacatttgacaaaacccaacagcactttataataaaaacactcaagaaattagactagaagggaccttctcaacttgataaagggaatatgtaaaaaatctacaacttgcatcatacttcatggtgaaatgctgaaggcttttcccctaaatccagaaacaagatgaggatgtccactctcaccacctccattcaacaaggtgctatgggttctagctaaagaaattagtaaaaacaaacaaacaaacataaacaaatttaaaaattcagattagaaggaaagtatctttttgtaaataacatgacattgtatatagaaaatcctaagtaatccattaaaagtttgattagaactgctaaaagagttaagcaaggttgcaggataagtcaatatgtaaatcaattgcatactagcaattgcaatgagcaatccaaaaataaaatttaaaaggcagtttcatgtacaattacatacaaaatacttagtaataaacacaataaaagaagtgaaaacttatgctctgatatctacaaaacattattgaaagaaattaaagaagacctatataaatggaaagacatccaatgttcatataatgaaagacttaatattgttaaaaaggcaatagttaccaaattggtcaagatttaataagttcttattgaaatcccagctgacttattttctgaatttgacaagctgataataatgttcacacagaaatataaggggcccagaatagccgaaatgaactttacaagtgactaagttggaggaatcacactatccaattttaaaacttaatgcaatattgtagtagtgaagacaaagtcatactggcataagaacagacataaacaggcatccttcattttactgagctttgcagatatcacatttttttttttacaagtagaagatctgtggcaaccctgcattgagcaagcctatgaccaccatttttcttttcaacagtatgtgctcgcttaatgtctcggtgccacatattattaattctcacaatatttcaaactttgtcattactattggatctgttatggagatctgtaatcagtgatctttgatgtgactattgtgattgttttagagtgccataaaccacacccctataaaagggcaaacttagtaaatagtgtgtgtgctctgaactgttccacagttccctcatctccttccttctccataagaccctaattctcctcaattctaaagtctgagggaggtgaggaagctgtagaagaagtgtttgaagctagcagaagttggttcatgagatttaaggaaagaaaccatctccataaatgtgcaaggtgaaggagcaagagctcacatagaagctgcagcaagttatccagagatctagctaagatcactggtaaaggcggctgcactcaacaagagattttcaatgtagatgaaaaagctttgtattggaagaagatgccatgtaggactttcatagctagagaggagaagtcaatgcctggcttcaaaacttcaaagaacaggctgactctcttgttaggggctaatgcagctggtgaccacaagttgaagccatttgtcattctgaaagtcctaggacccttaagatttatgctaaatctactctgcccgtgctctacaaatggaacaacagagcctggatgacagcacatctgtttacagtacgattgactgcatattttgaacccacagttgagacttgctactcagaaaaaaagattcacttcaaattatcactgttctttgacaatctacccaagagctctgatggagatgtacaaggagaggaatattgttttcatgcctgttaacaaaacacccattctgctgccatagatagagattgctctgatgaatgtggcaaagtaaattgaacaccttcagaaaataatttgccttgctagatcccataaagaacgtttgtaattcatgaaaggaggtcaaaatatcaacattaacagaagcttggaagtctattccaactcttgaggggtttaagacttcaatggagaaagtaactgcaaatgtgctgaaacagcaagagaactagaattagaaatggagcctgatgatgtgactgaattgctgcaatttcataatacagtcttaatgaaggaggagttgcttcttatgacttagcaactaaagtggtttcttgagatagaatctactcctggtgatgatgctgggaatattgttgaaatgacagcaaaggattgaagtattacataattttagttaattgggctgggtgccatggctcatgcctgtaatcccagcactttgggaggctgaggcgggtggatcacttcaggtcaggagttcaagaccagtcttgccaacatggtaaaaccccatctctaccaaaaatacaaaaattagccagctatggtggtgcatgcctgtagtcacagctacttgagaggctgaggcaggagaatcgcttgactccctgaggcggaggttgcggtgagccgagatcatgccgaaccgagatcataagaaagactgtctcaaaaataaatacataaataaaacaaaaataaaaataattttagttaataaatcagcagcagggtttgagaggactgactccaattttgaaagttctattgagagtaaaatgctatcaaacagcatcccatgctagagaggtcttttatgaaaggaagagtcaatcaacgtggccaacttcattgctgtctaattttaagaaattgccacagccaccccaaccttcagcaaccaccaccctgatcagtcagcagccatcaacatcatgaaagactcttcatcagcaaaaagattatgacttcctgaaagcttggatgattgttagtattttttaacaatagaatatttttattttttaacttatttatgttttcttttctactgacccattgatagagatcaataaagtatttttaaattaaggcatgtacattgttaggcatactattatggcccatataacagattacagtataatataaacataaattttatttgcactggaaaaccaaaatatttataaacataatgtttatttgcactggaaaacggaaatgtttatatgactcgctttatagtgaaactcactttattgaggtggtctggaactgaacctacaggatttctgaggtgtgcttctagattaatagaataggattttgagttcagcaataaatactcacttttaaagttaattggcatttgacaaggctgccaaaacaattcaattggagaaggaattgtctttacaaaaaatgggatggggacaaatggatatgcacatgcaaataatgaagttggaactttttcttacaccatacaccaaaattaatccaacatggatcacagacctgcatgtatgagctgaaattataaaattcctataagaaaatacagaagtaaatcttcctgagactgggtgggtaaaactttcttatatatgacattgaaaacacaagtgacaaaagaaaaaggtaagttggatttaatcaaatttaacaacttttgtgctccaaaggacaactattaaaaaggtgaaaataaaacccagagtgagagaaaatatttgcaaatcatatatttgttaagagatttttatctagagtgtataaataatccttgaatctcaataagaatcaaatagcccattttaaaaatgggcaaaggatttgaatagatatttgtccaaagatgtacaaatgactaataaacacctgaaaagatcctcacattagccattaaacaaagaatacgataccatttcacactcactatcacggcagatcacgaggtcaggagattgagaccatcctggctaatacagtgaaaccccgtctctactaaaaaatacaaaaaattagccgggcgtggcggctggcgcctgtagtcccagctactcaggagggaggccgaggcaggagaacggcatgaacccgggaggcggagcttgcagtgagccgagatcgtgccactgcactccagactgggtgacagagcgaggctccgtatcaaaaaaaaaaaaaaaaaaaaaaaaaagaaagaagaaaagtggataataataagtgttagtgagaatgctgagaaatttgaattctcctattctgccggtagtggtgcaaagttgtttttggaaaacaatctggcaggtcttcaaaagattaaacataaagttatcacgcttatcaattctgtgtccaggtatattttcaagagaaataaaaacatatatctacacaaaaacttatgcgcaaatgttcccagcagcattagttatcatagtcaaaagtggagacaacttaaatgaccatcaattgataaattgatgaataacctttggtatattaatacaatcaaatattatttagccaaaaataaatgaagtgcatttgtctcttggtatccatggagaattgattctggaacctcatgcagataccaaactctgggaatgctcaagttcttgatataaaatggcatagtacttgcatataacctacacacatcctcctatataccttaagtcatctctagataactcatagtacctgatacaatgtagatgctatggaaatagcttataaactgtattgtttagggacctatgacaagaaaataagtctgtacatgttcagggcagatgcaattaaaaaacatgttttccatctgagcttggttgaatccatggatgtggagctcacagatatagaaggccgactgtgtcgtacaagggttataagcacaagcttacaacttaggcagacctgggctaagtcagttcaatgccattattaatctaaatatagcctcagacccaattttctcatctgtaagtggaaatcataatagcacctagctcatgaagtggagcgtggatggactttgcaagcagtatgttaagtgaaagagactagtcacaaaaacatgctattgtaggactccctttacatgaaattaaatatggaatatgtggaatttccaaatctatagacacagacagtagatacatggcttcctagggcaggcagggagtaggagtgcagagacttggggacaaatggggagttaaatgataggttaaatttggctcgttcgttttaagtgccatgcccaatggcatgagatttcactttgggaatatggaaatgttctaaaacttattgtggcaatgggtgtatacttctgtgaatatattaggaaacattgtattttatactctttgaatgggtaaattatatggtatttgaaatgtcttaataaagctagtccaataaagagaaacaaacaaaaactccagaatttctattcatttaaagtcttctccagtacaagtatacaaattcaaacatcactaaaaattaaaaatttggggatatttaaaagataagaaaaattcaaacgtatgaaatgtacaacagctaacacccatgtactcaacaagatatttgaaatgttaacctcggatctttgaatgtgtgtgtgtgtgtgtctgtgtgtgtgtgtgtatacgtatatgaataggtaccaatgaagctcttgccatacccattcagttccagagtttaccactcttctaaatttggtatatgtcagtttcactcacgtttttattatttttctatacatttatgggaccataaataatatatcacattcagctggcatcactgtacatatcttttatagtttctttttttttttttttactcatgatattttcatgtttttgttaggttgataggtcaaattgggttcactcattttaagttgtataaagtgcattgtttgaatatacaaaacttacatatcctttcccctagcaatggcatttattatgtttctagttatttactcttagaaaggatatggtagtcacatctttgtatgggtattgtacatatgatattcatgtgtaggaggtggttatttgcaggggttctgggaagagcctggatgtgtggcttgtggtgtccattcatgtacacaaagttccttcacagagcaagatggattcgggggttagagggagatggggagggagccaggaagcaggaaagcaggaaagctcgcctggtcccattatcttccagtgaggaaccctgaggtatccaaggattccaaatctgaacctaggcttgtaggtcattagaaaaaatatttatccaggtattaacataacatatattttaactaacaattggatagattgatttataacttctaaatctttaggcccggcagctggaactccctttgaacttttgccctgcgccctgcagatgttcagtgtacacaaaatcctgttctatcagaaacagattcttaaagagagcctcagaataaaaggtgataagtgccatgctgaaatatgctcagtgtattatggtagaataggagtgaaatgctaactcgactctagctcccatgttaaggagtttacctgggaggcaactggcaagtgggaattgggagggggctaacaagggcacgcggttggaaacaacacggtggaggtaggaggatttcaaagaaagcgtgattattaagagcaatagaaaagaattatccacagttagaagatgaggcatgagtggaaactggtgcctgagcaccttgggtggcttgggcagtagccgtctttaccccacgggcatgggggtcacggcagggaatgaagcagcagctggagatgcagccagacccatgccacctggacgctgcataggttgcaggaggtagagtgtgatgggtgaaatctgaagccaggacacttaggtaggaaatcgttagtgcgaactcagcaggagatgaagaggaccgggcctagggcagtagtcccatgggagagatgggggacagacttgagacatattaggagatgacagtggcatcatgggtgtgtgcttccaagactgagctgacaattgcacataccctcagaaagggtccctttttcaagctatgtctaagttagaaaggtagaattggcctcagctccaaagagcattagacaccctcaaatcatctcaagggattgtatctctctggccccctagttggtgctaatcctgcctctttcacaaaaggtgctgaagaattcacagactcatcagacacattctctttggctttaaggagaaggggacagaatcagaggccttaagaggttcctgccctgcaaccgcttttaatatttggtgaggaagccatttaaatattttactgggcaataaaatatatgcataaacaagactacgagttggaattaaagggcttgtaatttctgcggatggattccgaccttgagaaaggcacaatgcatgtccctactcccctcagatttaaggcggtggtcgtcccatgccggtaccacaggctcatctactgggggtcccgggaagggcagcactgggtcagggcaggcaagaccccacaggcagcagatccccatcggtcccccttctgccaacacgcaagcggcccagggcccatctgtctaggaggagtggggagaatgatggggccggaggcgccccggaccccagtcgatagtccccagccagcaccagcagagcccgccgctgcccgtatcgccctgatctgaattcacagtgcctgcctcatgtaaatggcgctctatccggctggaaatgtgagtcctgtcaggagcactgggctccgtcatgcttatcagaaacacattatcaggtagggattagacagacacgggcgctgctgtgctgcccgggcccggcgaataatgaataatgaaaactccatggactggagacaaacacaatggacaggcaggggctgcgggagccacccttgcactcagctgaatgtgacgctccaggaaggtttccacttcactcaccagggccgcgtccctcctgggggccgcaggtgggggccgcccatcccctccgccaccccctctccgcccttccatcctggcctgcttctccttcacacttcccaagccagcaaagaggtcacttggccttcttaaaggaacctatggaaatggcgcagcaaaaagacgagactggaaagaaaaacttataggaatggccacaccctttttcatggaaatgggggtggggagagcggactccttggagccaggatggggatgaggaaaagccttaattactttagtctttacactttttttctcagaattcagttgactttgaaagatgtggagatgtggttaaagttctcaacataatgaagtatttacaataaaaatagatcaaagtgtattttaattctctgaattccatactccctcagcacttttttttttctctttggcagtggagaacaagaaggtggaataagtggtttcaatacagaacacaggtagcagtaattgtctctctccgtaaaacaatgccctgcattttaatattgtaaagatggaatacgctacaattgcaaagccctattttaaagcaaatgaaaacaaaacaaaacaaaaagcaaagaaataaaggggcttcctcccattgtacttttataaccaagtaaaatgattcagagagacacagcgttctctgatgaggggacatttggatgcagaatcaaggtctggcttttattcatagctctttctctcatttgttcctttatttcacaaaatgggcgcccataatgtggtagtccttgtactaatcaccaccagccagcactgagtacacccatcatctgccccagaagctcagactccaacaggagagagggcctgtcagtcaaaaccgcaacctgggagctaggtgatgtcattcaaagaccactaggatagctaagtgacagggaggcaagctttatttgagatatcagtttgcaaatcagaaagagagtctcctgcacaggttttggggggaagctgtgcctatttatgaggcagccgagtgcatgcacagtaggtaagcatatatggaacatatactccatgttcactttgaggcagggttttagcattaaaatgaggtgggatttggctctttatgtcaaaagaggtcagcctctataagctgctgaaactggcttaaggtgtgcagttgtttatcagaaaataatgttttcaaggccagtcccctatccagtcagagttgtaatgatctgggttgtaaatcagagttaggaggggtctgatagttcttgttattagagattttagaactataggaatctagaaatttgccatgccagtcggaccctgaccacttgaaagacaggtaactttgttttcataacattagggcctgtctgagctgataaagcagtgtctattttgatctctctgatcacagtaaatagtgcagggaaaacaagtatcagactcaggtgaagtggccaaaagaagatgtggcaagtcttccccagctgcaacagtgtgtgatcgtggacgagttcgtctagctgagctccgcttttcctggtgcacaacggctttgatgtcagcagctctgtagaccacacaggctcccatggtcctccctacagatgagagtgttacaataccccacagccagtccagcgaaatgacgggctttgaaaattgtaatatgccaaataaacacaaggagacatgactgatatcacttatttccactgttgctacagtttatatacacattactattctagagctatgactatagggttttcctgatatcctcacagcagagccaaaatcgaaatctttctccctggctgtgttttccgtgtgatttctatggtggatgatattgttcttactcttttcccataaccaaaatattggaaggcatttgttgcagtcagcaatccaagctgtgccccatctgaatggcatgcaggtgtgtgcatgtgcctccacccgaagagatggaaacagacctttcctagcatctgccgctacagcaggccctttcctccggggttcctgcaagtctgttccaatgaaggccgtgtgctgtgctgcatggctgagagaagctcacacaatttgacaatcactcgctgctcagtcactgagacagtcttgagaatctgtgaaggaaccagtaagagaaccagcctatcattccatagtgttttggttgactttttaaattgaaacataatagttattctcacttatggttcacaggtgatattttgatacatgcatataatacctgatgaccaaatgagagtatttaaaatttctatcacctaaaacatgtatctttgtgctgggaacatttcaactcttttcttccacctgttttgaaatatacaatcaattattgttaattctagccacgctactttgctatcgaacactagaacctattgtttttatctgactgtaagctcgtacccattaatcagcctctctctataacacattttctttatctcttcatctgttgatgggcacttaggtggagtccatatcttattgtggatagtgctgcaacgaacatgggggtgcagatgtctctttcatgtaatgatttgctttcctttggataaatatccagtaatgggattgctagataatatggtagttctatttttagtttttttgagaaacttccatattgttttcgtacacttatgaagaagtttgaacctgtggtcttaattccttatgagttgttcgagatatcttaggagcttatcagaaataatgtccaggatacagctgctgtggttcaatgcagctgcataaggtgtgttagatgagagcttgagaaattcctccccctttctggatgacaccttcagctctatgaacactcagccagatgaggggcattgctgatgttggctagctacaagttggctgtggcagcgagctttgctttgaacagtttacgagataatcttaggttttcttttatgtatgttatttcagactcactccttcctgaatatcagagttctttctctgagtatttcctcccatgcaaaatattgttctttctctttgatgatctaagtataacctctaggttcagacctcaactgctgtattcctcctgatccatttgtccagaaacagctcttagtagtcccctttcctaggccccctgctgatgtcagtatctaattctgtctttttcatcttttgtctaaatgaactcgactgattctcttgtaaattcagcctcttcttattttcaactctttttctaagcatctatcacctttcctatcttctgacttcccaatatattggcagtctatttttctgctttctgttttcatgttataactttctgttaagatattcacattcatatgcatttgttgtattatatgttgcctagacagtggtgaacaaggcacatgtggtttctgccctcctgaagccagacatgaaataaacaattgcacaaaatacatacacagacattatgtggggtgttatcagagaagtcaacgtataataaacatggcaagaggaaagcctaatttagatttgtagggtcagagaaagcttctctgaagtgataggatacaggctgagggaatggcatgttcaaaggctctgaaggacatgaatgtttgtcgggtgcacgtagatgaatgaagccgacatggctggctcacagcatacaaaggaaagaaagtctgaagctgatactagagaggaacacgaaggctaagttgtacaaagtgctgaaattcctggtaaaaacagagattgggtcctaaaagcaatgggaagctgccatgaggtttaatccagggagcaacatattcaggagcatgtcagaggcagtagaatataacctggactatgtcggatggcctggatttgaatctcagctctgccccttaccagctaggtaaccttgggcaagctactcaaacggtttgtgtttttatttcttcatttcaaagaactgagatgataattcatcaagggttgttgttctataagttaatagctgtgtagtccttagttaagtgcctgtcctatagaatgtgttgtatacatgttagatgagtgtgatgatatcacatgatgctgatggggatgatgatggcatttcaaagagatcccaatacctgccgtctggaggtgaaattgtaaggacaggtatctcgaggaagaggggaagtgaggaaactaatggaaatccttcactagcccaggagagagattgtgttatccttagatataaggagcagtaatgggaatagagaaaaatgaataaattagaaatatatttgggagacagaattgatggagttagcggtggattggatgtggggttgagggtaagggaggtgtcaaggataagttccaagtttctggcaagattaagtggatgaaaagacataccctttcctggagaaagagtagatttttcagggaaaagagcaagagttcagttttggacatattagctcagagatgcttttaaaatcatcaagtgggccaggcacggtagctcacgcctgcaatcccagcactttgggaggccgaggtgggtgactcacgaggtcaagagatcgagatcatcctggccaacatggtgaaaccccatctctactaaaaatacaaaaattagctgggcatggtggcgtgcgcctgtagtcccagctactcgggaggctgaggcagaagaagcgcttgaacccaggaggcggaggttgcagtgagccgagattgcaccactgcacaccagcctggtgacaaagcgagactctgtctcaaaaacaaacaaacaaaaaatcattaactggaaatgtgaaagagcttgttggatatacaggtcaagaatacaaagcgaatttgggccacagagaaacatttggtactttttagcacaagatgggggcaggtttgcttacaataagtgtacaatcagaagagaagaggacccaaggctataggttctaaagaactttaacatttagaagtcaaacataggaattcacaaaagataccaaccttctctggtcagctctaaatgggcatataataaactatcacggggactatgtaaagcttgcatagtgcttgtaatattcaaagtactcttttttttttaacatcagcagacctgatcctcacaataatcctattgaataagccactccaggctattatccccattatacagatgtgaaaactgaacaaagctatgcgatttgccctcaattagtaaggactgaatcacttgtagaaaatattcataaagtgctttttgtttaaaaccaaaagggcctattacaaataaacaaattctgtaataccttcattccgtaactaggtacacatttttgtttcggataaaggaatttaagctcagagattttgctcacagtcatgcattaagtaaagcaattagaattcttctcactaatgagcacgttgaatttggggtgcaatctgattattacacagtggatgctagagtacatcttcccagtttccaggacatatttgaggtttatttagtccagatcactggttctcgaagtctggttctcaaaccggcagcatcagcacacatgaaaacttgttggaaacgcaaattcccaggccttaccctagacctatagattcagaatctcaggggtgtggctccatctgtgtttgacaggccttctggaaagtgctgatgctcgctgactttggagactaggctggtctaggctagaacttcctactccatgccccacgcttgctctcactccagacgctccatcccaccacccagcctcctgtacaccctgaggaccacaggatttaaaagtctctaaagtttatctgtgtaactctaagtggtggggagtcacttttgaagaaagataagcaatacttataaataagaactgaagtgcattcacgtcagcagatatcgtttgaatgcctactatacacagatctggtgactagattttttttttaaacacctacatggtacaacctaagtccacaaactatagcaatctaaatctatgttgtaataattgtccgttccctaatgtgtcttttgcatagttatctcaaagtccttcaaaaatattaatattcctaagaggcaaaaaaagtaaatgttattatctctacttgccaggtgggtaagaaaggcaaggggaaccatactaggaaatgccagaggtcagaatcaaagccatttattttctttagaagtgatagtgaaatcacttactttatttgagttatccaaaagttatctacggcattgatatcattcccccatttcttttcgttttagttttaccttaaatgtgtactattgtgtgcaattttaaattaattattctactctaatggctaattttggttagcactttaactatgaaatcgtttcagcttttagatgagttacagctaaagttaatgaacggtatttactttcattaatgacaattttcatgactcttcccttccatgataaccacatagtgaaagctttcaaagctagagaaatccaacaaagggaaaattctacaagccctgctggtctgtaaggagagcagctggaggtggaaagcggggtgctgagatgctgtggaggatgggtatgggtaaagagaacctttgatattgcttcctgtgtttatattatctgccattgtccacatcagcaggctgcccgcaaaacccagctctatcagacatggaaatctgagcatggaatcttgtgtttctccaaactccttggataaaatattttttaaaaaatgtcaactgattggctctatgcttagtttaaatggtcacctggatatctggaaaatttagatctgaggtctccctctgtaggttgggatctgtgtatctgtggagctttttcacaagatgcacctgtctgcctcattctcctcaagggtattttaaatcccagaggtctggagtgggtcctaagcacgtggctccttacaaagccaccctgtgattctactgcacagagttactgacattaggacattgacctgacctttccttctgatgactttttaaaagatttggtatcctgtagatagtttgtgttgttgttatatatttactagggagcattgcattgtatctggttttgattgtcattgtttatctcttttaaatgagaaagaagtatatttgtggctattttatggaaatatttctgcaacatttatcttcttctaggctcctcctcttatttcaagtcacaatttgtaccaagttcataagggtaaaatgcttggatgcagaagcaatctgctggtaaggaaggctgtgtctgctgcttactagctggtgagattgagcaagtggcttgaccatgtagatccctcatgtgataaatagagctcataacagaccctgttgcctggaactgctctgagaagtacgtaagttattacatgaaaagtgctctgatcacatagtgagtttattgttttgatgctcaccataggacatcagcttcatcattattatttgtgaaaatgctatgtggactgaacttcaggttcttgtaatacaatataggtagaaattattttctaagcacataaattatatgtgcatgatgtcaaaatagtgtgtaacctctgggagtattatgtaaaagaaaataaaatatgtatcattgtggaaataagcacagactgtgttagtccattcttcattgttatgaagaaatacttgagactgagttaacttataaagaaaagaggtttatttgactcatggttctgcagactgtataagaagcacagtgccagcatctgcttctggtgagaacctcagggagcttccaatcatggtagaaagtgaaggaggagcaggtatattacatggcaagagcaggagcaagagagagggcaggaggtgccaggctcttttcaacagatctcatgtgaggtctaatagagcaagaactcactgattatcatcaggacagcaacaattcattcatgagggatctgttcccatgacccagacacctcgcaccaggcccacgtccaacattggaggtcacatttcaacataagattggggtgggggggacaaagcattcgaaccatatcgcacatcagtccagtgagagcaagcagcgactgtttacttggagtttgctggagcaagtgagtcagccaccatcacttgtgttttggcagagactcaaaggcaggcagaggagtggaagggctttataatggaaagagggaaggcttcaggtgtgccagattggaagttggtgctgtggagaagaggtagatgggctaactagatagaagtcattctgtgtgatcggttaggggtatgtatttggctttctctggttagtcctaaatttgaagtgggtccaaaatttagggaagttagtagttattaatcaagccttggttagttaaggcaaattgttacaaggtttagtgttgtcagtagaggtagcagtctgacttcctacaagtttgaattatagcaccctggcttcctaggcttgttactgtggatagctgggttggttttctgggcaggttgctacaggttgcagatcaaagttttatttttatatacagtctattcattattcatttagtatatttaggatactattgtattaattgttattgtacaaatgatgtttgctaatcaggcctatctgatcattaaatcaggagggctaaaacctgtacttaaaaattctttaagataaaaatatccacctaaaagtaataaagttgcattgattttttaaaatatattcccaaagtagttgctaaataggtatttcagaccaaattgatttcagagcttgttttaatgcatgatgttttttctcccacgaggtctagggtaaggttgtactttgtctcacttagatttttaatacatttagctaacaattctatacttagggaaagagtggtaaattacattaattgaaaggatatattattaggaaatgacttactgatgcctttgggagtattatatctttattcacccccctggatttttgcttaggatgtagttctatttttgctaaggataactgtgtggttgaagtgtgttcctggagaatttagtagaaaggaaactccaaaaagtattagttgatagacattaacttatttaagaataaaatttggcaaagagcaagccacctaggaaaaccaagaattaactgtttgaacatggctgtgaaattgttatgatgtgtctttaaatgcggcctcctgggtcacatttattgcccttgggatattagtctgttatgcatatgacttaaccccactaaagcaaaaggtctcatgtattggaagagtaaagggcacgtcacatggaaaatgtgtgactctggaagtcatgaaggcaaataaggccaagtttagtgatcactttcaccttgtttctactcagctccgaatccccatctggctcttttgctctctcttgcctcacataagaagatagggactttgagacttagaaaggaaagagactgtagggacaaacccttcccaaactcttaatttgaatgttaataagtaggttcacccaaagaggtgaactgaccttttcaaacttccacagtgagctaaaagcagatctaaaagcaaaaatcagatttctgctctactctgtgaagctatagtctttctgaaagtaaagaaaatacaactggattatacatacatacatatatatatatatatatatatatatatacacacactatatatatattacatattttatatatagttatttatatataattatatatgtaaatagtggatatatttatatagagatataatgtatctacatagatagcttactgtctatcgagtcaatgtgtggctatatgcacacatattaaacaacggcatgatttctatgactccgcttcagcctacccacagtcataaagaaatgagagaagtgattttcccatccctaacaagaggaattctcaggagaaagtttttattcttctgagaagttggggcagaattggcaagtcatttatattttatatctcctgaatctctccagtagccaaaaagcgggaccaaaaaagaatagagaagccagaaccatactcatgtgtaagtgagatcacatcttattataattaaatgcctttccagaattagcatttttttggccaaggccactctcattgctgagcattcgctttactaagaaacatttatcctgcagccaccaggaaaaatggaaactgtgaggactgcagaaaagttggccctcattagcctaattcagctccgtggtgggtgtgcagtgccatgccagggccatgcactggcctgggctctgtgcacccagctgtctccatggaaacccagctggcaacaggagggatggctccacaagcagacacacctgcagctcttaagtctcggtgcgttcgcttcctctcctcacttcattcacatctttttattaaatgagtcgatttgtcaccactgactctctcagacagcaaccccaggttctgttctgagggaaaaataaaacctccatttcaaacatttgcagagactcagagtggaagagaggggctgcagatgaaactgaagatgtggcagccctctctgaatcaaatgacttcattattcaggctgctccttctctctctctctcaagaaaaaaaaaaaaaaaaaatatatatatatatatatgtatatatatagcagaaacagcaagccatcttgactatttctatcactgatagaagacgtcattggatactttagttgtatgtctggtctctgagggtgttaaatttgtattgagctctggcttaaaagtttatttaacctagagattatttttctgctggtttcaaagaggtgtctcaaatgccttctcttctatataggcttctgatactatgttctgaagaaataatcagtcacagctttgactgggactcatccaggtgtgaacaccccatggttattgtattagagttttccagaccaaaaaaaaaaaatagggtgtgtgtgtgtgtgtgtatgtatatgtgtatgtgtgtgtgggtgtatatacacccccacatatatttattataaggaattggttcacacagtcatggaggctgagaagtcccacagtccacagtgggcaagctgcagaccccgaagagcccatggtttagattccagtctgaagcctggcaaagcctggcatcctgagacctagggagggctaatgttttagttcaagtccaaaagcaagaaaagcccagtgtcccggctcaagcagttaggcaggagaagtcttctcatactcagttcttctgtcctatttgggtcttcggttgactggaaggggcccactcatggtgaggggcagggcactcactttgccccactcagcccacctattcgagagtttgtcttatccggaaatgacctcacagccacacccagaataacggttgaccaaatgtctgggcacgctgtggcctcattagcttgacacatgaaattcatcctccaagtttctttcccagtccttcttgggccctattttgatgttaatttctaaagtagttattactaacagacagtacttgatacattgcctcaaatcctttatggaaagggacagcatagataaatcaatgaaaaaatataaaatatagataaatagggaaaattgctatgattcacaatatttttaaaataacttgtattgcatatactacttccccagtgagtctgcttacaagtccccgtaatcagaaatttaaaatacacagactagatatggatttgtttaccagtgaagacagtgttatttgcaactagttagttattaaaaatttttaaatataaatgaaataattcagcccctcccctacttgccaatgtgtggcaagaagcaaaatgagctaaattcatgacacacactcacggccacccttttacacatggacctggactacttactggttttcataaaaatctttacctgttacattcctctacctcccagcctattctgagtcaattcaaacctgcggactcatggatttgcaggaggaaaccagtgatttttaatcggtatctttcctgccatctgctttcaaaaatgccacagcatcaagcaatagtcttagccattttctcaggggactaagtttggaaaggggagtgaaagaggtgattgctgaaaaaatctgaggaatagaaaaacaacccactattaatatgctaaggtgagaagcccttgaatgtcccatcaaaaaagctgctgtccttggtcttcctaccgttggcactactgatgcgactcacggtccctcacattcattggaaccagcaaatccctctcagtgtctcacgtacagtgtggagcagagagctgtaccactgcttaatgttgcaaactaccagaagcaaatgaactcatgtccagtacagagggtcaggagaagtgcatgaccctttattgttgactgagctccatggtgtttgtgtaagacctgacgatgtgttttgatgaggattgtgatgacaggtttggattttagatgcatttgcccacttctcatgggaaacactcacataaacatacttttccatttttctcacacactatgtgatctatgtcagaatcagagcagcagctcctaaatatgaaattaaacaacaacaacaaaaaaataagtaaagaagaaaggaaagagcatccatgaaaacaagctgaaaaggttaagagcaagaagaaaattgtagaacagtttcggtctgtttggaatgaattaatcagaccattaaacaaatcttaatctaaagtatccctttcatttctgtacccataaaacaaaatgatggagagttggtggcaaagtctgccactgctccctatttgtattacacagactggagctccgacctcattaacattctgctgcaggggagggccacacattcaggctgaaagcatgcagagagtctgggcagtcctgagctctcacccagcttgatatacagcactgagaagtttcttcctctcttttacctatctctctctctctctccccacgccccccttctgtctatctatcatcactcacaacttgaaaaatataataaaatctttgaagagtttcccacaacattcctacaaaaaagtacttaaggctttccattccaatatgaacacagtttcagggagtgcagggacccccagaagcccatctatggattttaagataaagagtaagggaaaaaccaatgccattcccttatctcgactaatattatagagaaactgtcttcagatcctttactgggacatacgctgtgatacatttcaagttaaagaaatatacaacttaaggccaggtgtggtgactcatgcctgtaatcccagcactttgggaggctgaggtgggcagatcacctgaggtcaggagttcgaggccagcctggccagcatggcgaaaccctgtgtctattaaaaatacaaaaatgagctggggctggtggcaggtgcctgtaatcccagctactcaggaggctgaggcacaagaatcacttgaacccccgaggtggaggttgcagtgagcggagatggcaccactgcactccagcctagactacagagaaagactctatctccaaaaaaaaaaaaaaaaaaaaaaagaaatataccacctcagtgtaattcagtgttattaatcgtatatcagaataagaaaaaaggaatattcagttaaaattctcttatattttttgtcaaaagttatattggcaatgaaatattaagtcgggcagtggggaggcctagagctaatacttctacgaattgagcctatgactttggacatatcttttaatttctataggccttgattttctcatttgtgaaatgacttcgcggaactggatgacctcaaaggcccatttcagtttttatttccatattcttatttgttggtggtgtcctagagagaaaattacagtgacagtaaaaatgggcaaataaataaaagatacaacaagaatataattactagaatgagactgcaaaattccacagaaaaacacggatgtaaaatgctgctgaattttacttgctgtacaaataagtttcctctttatataacagtaaatgctattttatctttacactaaattatatgttcttgaggtcatgatttgcatttgatttttttactttttaatcttccatgtctcttagtatcgtaccaactgccatgtagatgatgaagaaacatttttggttgaataaacggaggtgtaaagtagaaggtggagggcggcttgctagcacgcagcagtgtgggtggcctggggccagtgcagtgactgctgaaaggccaatttggtagagttttaggaaattgtaagtttttaggagctgtttgattgataccaacagagaacacttggcgagcttattggaaaaggagagtttatgtaaagctataatgacacaacatgcctttgctccctcgtttatctaatcacatctgcatttcagtgtgctgctggcctgtggcttccctaagttactgctggtcagccttccaggagaacataaacctctcttctttcaggaaacaaaggggatggttggctaaggtctctcctggaatttactgctgcccatgccgatccagagatgaggaatgccagatggaaaaatgagagctttttgtcccttgagtaaaaagaaaaagagagagaaaaggtttatctcattatgtgggaatgaaagaactaagctagctgtgaagtggtctgcgcctttaaacatgagcctgaaggtacaggtgtgagaccagattcaaacaaggattccgtcgttcccaattagctcccaacctctcccgctccctctccttcctgtctccacctcctgctccactctttcctctcctttttggaatatagcaagattaagtggccgatttatctttttggcgctgaattttaaagggaacagctagctgtgtgatcctattattaatatttatattctgtcacagaatgttgacagattaattatgcaacatagtataaaaatcagcaggcagcgtgggtgagcagaggcaaagttcatatattagtaactccactgggtggctggcacctgccccagaatgactgtgggctccctggagctctataccccagttccttaccaataaaggacctgctggctttatttcaccctccttacagttcaaggtttcattgttttggacataaaaaagtaatgttcatgaagcttcctttgtgcgtgctctaactagttctaactaggtgtcctaacaccctgacacagaccaccttaaaggaagtgcatgtgactgacagatcttctagggtggacacttcctggaatgagcaagtaagttggatggggctctttttcttagaacacaaataatcatggttgctggtgagtatctttgcatgtcatgctctgctagttcttagagagtaccacaaagttaagaaagtggagccccagtccttaaggagcttataatttagttggagaagtaaggtctcctttggtgatggtgcatggagaagggtagtgtgggaagccttcccagctttgtagctaaagattactctctcttgttactttgcctctgtggaccccaagttcctttggtgatgatggggctaatgcagtgatccctctggcctttgatagagggaaattctccaggaagcaacagagagcgatgagcaacaactgctcgcactgacctgggatccaggctggctccatagctgcttggtcctgggcacgttacctaactaactgctctaagcctgtgtcagtccattcttgtgtctctgtaaaggaatatgtgatgctggataatttataaagaaaagaggtttcattggcttatggttctgcaggctgtacaagaagtgtggtgctggcatctgcttctggtgaggcctcagggagcttccactcatggtggaaagcaatgggggaccagcatgtcatgtggcccaagcaggggcgagagagagagagggggaagtgctacattctttgaaaaaacagatcttgcatgaactgagtaagaactcacttatcaccagggggatagtactgaaccattcacaagggatctgcaccatgatccaatcagcccccacaaaaggccccacctccaacactgggaatcacatttcaaggtgagacttggagaggacaaacatccaaaccatatcacagctacagtcttcgtttgtgaaatgaaaagataacaccaccagggtttgttatgttatgtatacataaggtgcattagcatgaagttaatagctatgctgtaaaaccaccatgggtgatgttcctgaaagaaacaggatgcagctgggcgcggtgactcaacacctataatcacagcagtttgggaggctgaggctggcggatcacctgaggacaggagttctaggccagcctggccaacatgtgaaaccctgtctttaataaaaatacaaaacttagccaggcatggtgaggcatgcctgtagtcccagctacttgggaggctgaggtgggagaatcactggaacccaggaggcaaagcttgcagtgatgagatcgcaccactgcactccagcctgggtgacagaacaagacgctgtctaaaaaaagaaacagaaagcactggggtcatgtgacagcctctactgttctggatattgtcactttgtactttaacttatatatctaaggggcagcattctgtggttcataggtggcaggtagcatttctgccatgaagtatagctagtgtcccatatgacacctgtcgatggaaccttgggctggcattctttgaaagaggctgaggagctctgctgttttctaggagcctctgcaggatgcccagggccaggcacccgaggtactttagtgggtgctaaggagcagcaacatggatggtgaaagaaacttcagtgggaggacatcattgcgtcactggaggaggctccacagtggcaatcgacaggcagcctgctctggagaggggtaaggttatctcagagtgccagggaggctcaggtgtcagatgccacatgcatgcagtttgtcactgttcctctcagtgagttggtgtgtgtgtgtttggtggttattgaaggaagaggaatagataattctgtagagaagttcacttgaaccaatcagctatcaggtcacataacaaaaagctgttgcaatcacaacacatcaaatcaattctgggagtgatataccttataatcacgcaatgcaaataatcaaactcaataagcaagcaaaccttcagtgtcatcaagcaaagctccaactacaagtagctctgatagctttaaatcagctctttaactcttatgctccagctaccatagtcatcgatgtgcttcccaagcctagctgggtaatgtagcatccagaaagatgctgctccagttaacaatttatcttcacttagcaagtcagctgattaaattaagaacttattaatatcccaagatcatccatgagttagaagaaaaaatatcaattgtaatatacaaaggcaactgctctcatattcattctgacggcagtccctcctggatgctcacctgtgccaggttggtgggactgaatgggggaaaacacgagaaatacatgatatggctctcaccctccaaagtgaattgggataaatggtatatacacaacaaataaaaatacagtgtggtcagtgtgatgctatttgtattaatcaataagaatgtattaatcacctactgtatgcacagccctgatgatgaccccagtcctggaggcacagaaaatggcagtcgctgtcttgatgggcacagtctgctggagacagtgaggaacatggtgaggttgcaagggggacagggaatgataggaggatgtctaggaaagaggggagccagttattctaatttctggaaataaaccttcaggcagctaaaattttgtgcaacatgctcatgcagcccctttgagattgagatggtgaatcttagcaccactttgcaagcacagaataagaatctccaagggcttgggtgtggactggggtaaaacaggagatgaaaagagagcgaggcttgtggctttccagcactatgtcccacttcatcatttgtaacactgaccattcttattggtcggagcctgtacgatgaaaaaaaacactttgtacgttgatgtagggtatctggggaagtaatttactgcttctaagccattagaatatgatttaatgcattagcaataaattaatagagttaagaagaagtgggaattatttcagtgtgtggatgagaacagcagggcagggtagaccaggctgcgtgttttgaacccatcagcactgcatttgtatgtgtcagataaccttctaggagctgcctcatttaaaatggaccccaatgaagcttaacacatagagtacagtctgttcaaaatgagccagactataggtaaaatttgacagcatgacacacgatcttcccagacaggctgtgttgtaggacataattttggaccaggaaatttttgaaagtcaaatccttgctattctgctatgactgcagactagtgggtgctaagtacagagccttttctctctctctctttacaaaactcaattaaaatgtgcatgtgcagtaatcttccctttcagagcgcctgtggtgattgatagagttgtttctaagtatgtttaggctcagtggaatcacttaacccattgtgggacatgcagaaatgggcaaagaaaaagaggccataaaaattatacagccagaggaggctgataatatccagaagaaaggagatacagaaagagaattgaacacatgacatataagaatgagaagggatggaaatgcatcctctatgaattgttcattgtgcccattttcaaagtgaagaaacttctagaatatgggtgaggcacagttttcgatacaaagctcattgcgtgtttaccaatgtgaaggttaattgggaggtaagaaaatgccaccatgatgctgagacttttctattgctgctttttgtcggcctcaccaggaacctgcagagacagaagaggtcctttgatagccacatttgcagcccacgttgctcaccgcgagccggcaggttaatgtaccgctgccagccctccagagtgaagcaatcagacacacggcttgattgaaataaaatgaaagggggagtgggggagggcagagcctgtggttggtatttcagctaccggcaaagccctcctcaaatcaaaccctccatggaaggcgggtattagcagggtggctgaggggcacctgcaatgcggagattaatcccctttttgttttctttcgggtctatctcagcactgctgagtggaagaatttatgttggcctccttcctagaaggaagctgcaggctcagaaaagaggatgtgtcatcagatgtcacctctcagggtgcctctgttgctatctgtctgtcgctctgcccctccctaggtctctgcccctccctgccaatcagttctaccttcctttcactcctcagagttttatttctgtggctcgaattctgatttcgtaccagaggaagacaacaacagctctattaccaggtcccctgctcctctccaatgtgccccagacaggtattcggcgaccagaggagagctgagctgggctttgatcacactctgcctctgcatccgcggagcttgctgggccatgcagatgtcttctgcaagtgagctaaggccatggaaaagatccctcgggggccatttgagatgtagctcacagtggccttcaacatttttatttaagctgtggagtcattttctggaaaataaaatatcattgacaacctcactatgtgaaatggatagcgtgctcttattgtacaggggtgagaagaggatagaggaggcctgaagttagcccactgagccctccacttcccaggaccctgaggccactgagcacaggcccttgtgcagccctgctcccggacccaccgtgactgtgatgtcctggaggaataagtgccctccttccattcatacaaaggttcccaactggctaccaaaggctatggccagtccctggaaggcatgctgtttccaccaggatcctgaaatcccaggttctcaaatagggtcctacattttcaccaaggagctgcacactttcccagtgtatatgtgactattcgtcgccagcatgtgcacgggaccattttggtgtgtgattttttcatatactttccagggtgtttatgactagggtgcaattttagaaatgagagctttggtagcaaggtcctgaccatcccagagaaggattttggcaaaaaatagtagttgctagttatttactcttcctctttttgctagatcaggtggcagaaaagatgagttattgtcttactatcttatcttccccagtatttcatttcccaatactgaagacagtggaggcattttggacctaagaaccagtgtttcagaagatggcatttaccctacaatggccgtgcccaaggtaaactctgggctttgggctgcatggccccaatccagagaacagagggactattcctggctccttcctgagctgctctaacatcctgcccgactgagcccagttatgcttcatttacaagaagaggccgcgttagctcctggctcatgtggagttaaatagagatgagatgtaacactttttttctaacagcacaaaactccttcctgaagagtcaccttgaagagagatggtttcttgtgcagaatcgcagtctgggcaattaagtcagagaactctgagtttatatgctgtgcgttttcattgactgactctgtggctttttggagaattacatttcctctctgatattgttaattgatgaagtctcacaacttcactagggaataaacttatgctgacaagagctgtgtgtgtgaaccgtgccatgcagacttccttagatataaatgagtgtggtgggagcctcgtgggggctctcaggagcctaaacataacaaataaacaaggataataggattaattgcttgtcttgcattctcacctattcctttttgtgccttcagagtccatagtaagtcactggtctatttaactgcatttcctctgctgaataatcggctaattgatttattacaggcgtggcctctctgctttctattgcttagcatcctgcagtgagctttgttaccttcttggccctgtttattgaatccccatcgtgcaagaaacaggaaatttggcactaagcagatgggaaaaaatgcattgtatagatatcaaagcatagtggttaaatgttgttctcttctgaggtggatggctcccaagaccctggtgctttttgaaatatgctctaactaacctatttttccatgtgaacaaagggctcagtggatgaaggttattttcacatagccctcaaggttaaagttggttgctcttccagatggtttctatctaattctttggattatgatactgaactaccctgcgatcaggactcctagtgccaagaataacaagaggtggaagccagctacagtgagggctgctgctctctgggcaggcagagatttaagggtcaaggccagaccatatggtctatcaaggccctgctgccttaaccccgggaaatacaaatcaactcacagaaccgctcatcatccctgcttcctattgcgtcagtcactgggccccctgagtccccccttctccaattctttcttgccctaatttttgccacaggcttctttctgcagttgccagttcaattccagctgcccgtgcttccagtaggctcctcagaaacgtgtttctaatggccacagagtcgaatggcacaatgaggagcagaggactccttggcttagcagctccagggggaggtattttttttaagcctaacctgaaagcatgtgacttaaacacctgtgacttagccacctggtaggaaaatcaggtgggaaattagttctcccatgaaaggcttattatttctgtgtgcttccaaggaagtaaacctggggaagttgggaagagaccatttgagaaagtcaaaatgtacctcagtatctatttcttgtttttcctccatcccttgctttttccctccctccgtgtctttcctcctctctcccttcctcccctctgtccttccttccttattctggagacaattgctccagcacaaaactaactaactaacttcaaatatttgctatcttttcagcaaggatataacaaaactaaacacactcaacaaaaacacaagttccatgagagcaggaattcgtgtctgtttggtagtgcggtatccccagcatttaagacaagtgtttgggacccagtaagtgttcaacaagttatttgttgacttctgaataattatgcgatatttgataataaaagctgaaattcttattttttttctttcctctaataatacctccctatatgaaatctgaaggatcttgcttcagaatcatttaacactggctgtcatttccttaccttccccagagtcgcactcagcacacaaccccagggtgcagagcattccttccagtcttctccccatgatgcctgtgtgaacatcttcaaaattgcatttgaagagatgctgttgtgttcccatgtgcaaggtctcaatggactggaatcttgtaaatgcctataacctgtattccactcactttctttcactgtagatcatgaggaaatgagatgtaagttgtgtttgtctctaccacagagataaaagaagaggggtccggtgcttcgacctttaagcatcgaagtcagctttggtgtgggtgcgcgagtctcccacatgcgtgtctgtggcttctttccaccccgcctttacatgctgaggatttacattccttggttatgctactggactggcccacccaaaggcagcgtctactttgagggtaggagcagatattgaaaagagaattccatctcactcattgcttttgtttttgacaatgggcagctgtgtgtgagctatgggagggttcagcagcctggtgttgaggaaggtactttgtcttgttgagtgagtgtggttctggagttcagtgaccccttactgaggctccagtcacaaagtcttgtttgtggggatgtctggatgcttttctttattaaaactactcagcatatgaggcaggagaatggcgtgaacctggaaggtggaacttggagtgagccaagatcgcaccactgcactccagcctgggcaacagagcgagactccgtctcaaaaaaaaaaaacaacaaacaaaccaaaaaacaaaaaaatacaaaaaaactactcagcatagttatcacttctttcagtgtagaccctaataacacaatgggcaaacccaatacccccacacccccacaccccctttcccgttcccagtggtgcatcagcgacctcaaaccccctcagcagcgcagcctcctcacctcacagagcacttacagagctgacctcaaagagcaatttcagtcaggaaaggagaggctcaattgttcataaacctgacatttattacttggagattcttgctctacagtacaagctgctctttacgattttatcaaataaagtgctcctttcatctgtgtcccactttctcctcccgcttcttcccaccacccactgctttcacctacctgtgggcttggcgaggggcagcaatgtaagatttaaggaacttcacctggggagcccgggtctccttgctgggggcctggctggcactcagagcagagggtgtatgcttcgttttccttcttttattcaagcagcaatgagtgtgaaaggagatagtggcattgtttcctcctttaaatgacttaccttctcttggacattttctaggtcaccaggtcagagtaacactgagagtaaatctattgcaagcattcggagaccgaatggtttgtaaatgatagctacacacattaattgtttcccagtttaaataatgagagcactcagtgtagatatatgtagatgtattattttaatggacagtacccaaattgtagaagcctcaatgcttcccatgttgctttaactgagctcatattttggacgatggatagttcagtggtctggaggcagggggaggagttaaatgaatcactccatgtcctactgcatatcagttgatagtgtcatgtagagatcgacggaatgggggcaagccattcaccagttctgaatcatagatggtcttttggatggttatagaatctaaactgggcagggtggagctgtagggaactgggaatagtctaaaatcagaacaatgaatagaagccctttacgcgtctccaatagaataagcaggtaccttgttacaagaaaaagctgagtacactggtgtttcaaaagcagccatggagaagacttgtaaatataccacagcgtgtacgtgtacctttgtttgacttctgacactgggtcaacaccatctctttgagactgtgtctgctgactggaaactggtgtctccttgaatagacaatattctgacagtatcactcttgatttctactttgaatttctttaaagtcgagcatgagggtgaaggttcctaatgtgaacctatctgagtataaaatatttctagactctatgatttctccccatccctactaggtttttcccccatatttaattcaactgcaggagggttttttttttccaagctattatattgaatatttctaaaatattctacttagttttcatagaaatgacaattctctttttacactcagattgtaccagtttgtgagggttttaggtaaattatgtaattaagtgaacaagtacacctggtaagcacagagtttggaaatgatgcagctgactcttggtaagcatatggctcaactagtaaacgcatgagcacctgggtaagccagagggagcaaatggcatagactgggaattcagcacactatggaagtcagtccccatgactgccagagagtggagaagtctgggtaatgcagtatgtcggctaaatggaagttcagaaggaattagtgaagaacttttggtgccggcttcaggtggactcatggtttctgaatttctgtgctaatattagttattgacctcaaagaaatcccataacctctcagagcttcagtttactcatgtgtaaaataaggctattactaacacacgtgagcatgcatatacacatgtgtgcgtgcacacacacaccacccagggctccttaatgaaggtcgaataaactaatatgtttggctgctcttgtaactgtaaatagtctacatatataaactcctttttagctttttaccttaaaataatttcacacttatagaaaaatttccagaatagtacaaaagcactcactaaccccctgaaagatttgcctactgttaatatttcatcacatttgttttatcatcatttctaggaatggagagatgggtagatagatagatagataaacatagataatgtacatatctgtgtgaatcaatatttttctgaccatttcagatatagctgcaaacatcataacccttttctccaacacttccatgtgtttatgttaagaacaagatattctcttacaattacgaaaggatatttaacgtttatacaacatcatataatatgcagttattattcagaattttccatttttgctagtaatatcttttatttttcttccatcttggatctggtaccagatcacacaatgcatctggttgtcatttttttttaatggttttagccttcttctgtcaaggcattgtccctgccatggtctgaaatgtttgtataccccaaaatacatactaaaatcctaatcctcagtgtgaggggtcaggaggtggtggctttgggaggtgatcaggtcatgagggtggacaattgatgatggggttagtacccttataaaagggtctcaacagagacttctgccccttctactatgtgaggttccaggagaagagtttgtctgatatgtcctggactcaggttatacatttatgggcaggaataccatatacatgaaagttcatggtaggagggcatgctgttggcatgtctcagtattggtgatgctagcaatgatcacttggttaaggaagtatctgccaggattctccactttaatgttaccatttttctgagattagtaagtaattgctggaaagacattttgagactatgtaaataactttccttcattgaatttctgtgtagcagcctttgataattctcacctgagctggttgtcactggtacggatgcatgatgctggctttttttccctgatgccatcattccttatatagttattagttgacatatttatgtaaggaagaactttcccctttacaacatttatttagttttttttttttaaattataagcatgggaccatgacattttattctattcaacagattataatcaatttatgttatttgttttgatttcatttgtcctagatttggccagatagtgtcccatcaagctggccctgtgctattttgatgtgtgctcattattttttgcacattttctttctctctggcatgacagaacattttagacgcacttctgccttctctttccagtcctgaagtcaagcctgtctccaagaaaacctagttctcttgagtagtggatggtatttaggaaccaagatcaaggtgctagctgttttcaatactgctagggcatcactgtctctagaaagcagaaatagggagacacaagatatttttccaaatctatttctgggatattttccttcttttaccttcctgccatcaccatcacactcatattcctcattgatgaaaaagactgttatagatttggactctgcttctatctgagcttagaaagataatcaactccagtgttcttgttctgatagctaagaagaaaagattgtcctcagggctaaattcaggagcaaacaggtaagaatctgctcatatcaggaattaagagatggaaataacaggaagccgtgccatcggtatttacatggagagccaccatagattctcatgcctcgtggttgataatgtcacaggtctagaaatctcgcattaaatttccaaagttcctgggagaacttctcctttagggaatgtttcggataataaaaatatgagattttaatacttgtaattatgttacagattgtactcactgacgacgtcttgtttacttattactcacattagccctcctcttgaagccctgtggcaactaagaacagaaacaagactgtggatgaggtcaaagtccagtaaggactttactaccctgaaacccagggctctagagccgtacagtcttgtcagatgcatcttaggcctcctgccaccaccatcatcatatctagatcctgtggcctttcttggggagaggctgggtcagcaaaacgaacgctagctccctcatgcctaccttctgaggggaggaatgtgtcttacccaatcaaatgcaagggggaaatcaaagaggctttgaggacagtgtcagaggcaggcgtgaggctctgcctgagctatgccggctgtgcacaagccctggtagagcaatgaaacaggttaccttgctagaatgtgaattttgcagagcacagggaaaataccagatcatatttgagcttaattgtccttacatggagcctgaggaaaggcagactcttactagtcagcaaagccacttcccctgcattggagaggagtgaatgagaggctcaaagagctaacagatgtgctcatccaatctggctttcttctgctcagtggaacagaggtcctccatggaaacacagggaggagtgagaaaatacttctatctcctgaattcttactatgtgctgggttttatgatgagggatttacatgcattatctagtttgattctcatgataaccttataaagtaggtattggtatcaacatgttatgagtggggaacctgatccccggaggttaagccatatcccacagctcatacatggaaaataacgtctaaaaccaggtcttctctctgcagtcatgcagttagtcaccagtttcagggaatgccaccaatcttagggaagattacttccccagcaggtaggatgagtaggcccatgaggaaaggctcacaggctgtgcatgcacttgttgggttgggcggtgagcagcaatggtggggtgggaggaaggatgaacacaaaacctcacccactctatacttccactttctggccagccctgagccacaggcatcttagtgctaactccttatttcaaagcttatgaccacagcggagctggtaataggcatttctttgattttctaattattttcctttttcctctttggaacatctctgtgctgggagatcaatgcctcctgctgatcagctacccagcagcttaaagaacatctcaacatactcacttaaatttccataaggtgactggcataatgcctttgaggcctagagggagccctggtagtcgtcaggcaaagcaaggcttctgaggccagaacgtggttgccttcatattcacaagttgatttatttatcattgagttctagtgtttgtgagcaaaatgagttctctttgtggtaagatgcggaatgaaagcggggaaggcatggctcagcaggagccagtgagagagcagcttggtgtggccaccttccgaggagtgacagctcctgtgcttagctaggcagggccgcatggacaacaccaagagcactctccagggctctgccacacagaaacctgggacattccagcagcactgtgtctgtctgcgttctttttctacccctcttcttctgtattaatcagtagctcctttcagatgtttacaactcattacatcagatgtagtcattctatgcatcactaatagtatctccctgaagatgcccccagatagcttttcctggacttctcatttaaaagaacattttgatcataagaagccacaacgcatagtggaaagagcgtcacttttcaaattaggcaaatgtgggtgcaatcttaactcccccacttactagctgttaacctcaagaaattgtcccaattgctctggatctcaaattcctcctgtaatatattaatatgtataattagtactattactaaaatgaaattagtattgagtagattaaatgacttaatcaatgtaaaggccttgaataatgggggcctggcaagatggccgaatagaaacagctttggtctgcagctgccagcaagaccaacacagaacgcaggtcatttctgcatttccaactgaggtacccagttcatctcattgggactggttagacaatgggtgcagcccatggagggtgagcagaagcagggtagggtgtcgcctcacccgggaagcacaagggttcagggaactccctcccctagccaagggaagccatgagggactgtgacatgagggatggtgctatctggcccagatactacgcttttcccatgttcttcgcaacccacagaccaggagattctttcaggtgcctacaccaccagggccctgggtttcaaggacaaaactgggcggctctttgggcaggcaccgagctagctgcaggtgtatttttttgtacctcagtggcacgtggaacaccagtgagacagaaccattaactcccctggaaagggggctgaagccagggagccgagtgggcttgctcagcagatcccacccccacggagcccaaaaagctatgattcactgggttgaaattttcgctgccagcacagtagtctgaagttgacctaggactctcgagcttggtggggggacgggcatccaccattactgaggcttgaataggtggttttcccctcacagtgtaaacaaagccaccaggaagttcgaacttggtgtggaacccactgcaatgtggcaaagtcgctgtagccagactgcctctctagattcctcctctctgggcagggcatttctgaaagaaaggcagcagccccagtcagggtcttacagataaaactcccatctccctgggacagagcacctgggggaaagagcagctatgggtgcagcttcatcagacttaaacgttcctgcctgccaggtctgaggagagaggcggatgtcccaggacagggctcaggctctgctaagggacagactgcccctcaagtgggtccctgacccccatgcctcctgtctgggagacaactcccagcaggggttgaaagacacctcatacaggagagctccagctggcatcttggcaggtgcccctttgggatgaagcttccagaggaaggagcaggcagcaatcttcgctgttctgcagctcccgctgatgatacccagggaaacagggtctggagtggacctccagcaaactccagcagacctgcagaagaggggcctgactgttagaaggaaaactaacaaacagaaagcgagagcatcaacatcaacaaaaaagacacccacgcaaaaacccatccaaaggtcaccaacatcaaagaccagaggtagataaatccatgaagatgaggaaaaaccagtgcaaaaaggctgaatattccaaaaaccagaatgcctcttctcctccaaaggcccacaactcctcaccagcaatggaacaaaactggatggagaatgagtttgatcaattgacagaagtaggcttcagaaggtgggtaataacaaactcttccgagctaaaggagcatgttctaacccaatgcaaggaagctaagaaccttgataaaaggttacgggaactgctaactagaataaccagttaagagaagaagataaatgatgtgatggagccgaaaaacacagtacgagaacttcgtgaagcatacacaagtatcgatagctgaatcgatcaagcagaagaaaagatatcagagaccaaagatcaacttaatgaaataaagcgttaagacaagattagagaaaaaagaataaaaaggaatgaacaaagcctccaagaaataagggactatgtgaaaacagtaaacctacgtttgataggtgtatatgaaactgacggggaaaatggaaccaagttggaaaacacacttcgtgatatcatccagtagaacttccccaacctagcaagacaggccaacattcacattaaggaaatacagagaacaccacaaagatactccttgaggagagcaaccctaagacacataatcaccagatttaccaaggttgaaatgaaaaaaaaaaaaaaaaaaagttaagcgcagccagagagaaaggccaggttactcacaaagggaagctcatcagactaacagcagatctctctggagaaaccctacaagccagaagagagtgggggccaatattcaacattcttaaagaaaagaattttcaacccagaatttcatatcccaccaaactaagcttcataagcaaaggacaaataaaatcctttacagacaagcaaatgctagggattttgtcaccaccaggcctgccttacaagagctcctgaaggaagcactaaatatggaaaggaaaaactggtaccagccactgcacaaacataccaaaatataaaggccatcgacactgtaaagaaactgcatcaactaatgggcaaaataaccagttagcatcataatgacaggatcaaattcacacataacaatattaatcttaaatgtaaacaggataaatgccccaattaaaagacacagactggcaaattggatagagtcaagacccatcagtgtgctgtattcaagagacccaactcacgtgcaaagacacacataggctcaaaatatagggatggaggaatatcgccaagaaaatgaaaagaaaaaaaaaagcaaatgttgcaatcctagtctctgataaaaaagactttaaaccaacaaagataaaaaaaaaaaaaaagaagggcattacataatggtaaaggaatcaatgcaacaagaagagctaactatcctaaatatatatgcacccaatacaggagcactcaaattaataaagcaagttcttagagacctccaaagagactcagactcccacacaataagagggggagactttaacactcgactgtcaatattagacagatcaatgagacagaaaattaacaaaaatattcaggacttgaactcagctctggactaagtggacctcatagacatctatagaactctccaccccaaatcaacagaatatacattcttctcagcaccacatagcacttcttctaaaattcacctcataattggaagtaaaacactcctcagcaaatgtgaaagaatggaaatcataatcaacagtctctcagaccacagtgcaatcaaattagaactcaggattaagaaactcactcaaaactgcacaactacatagaaactgaacaacctgctcctgaatgactactgggtagataaaaaaattaaggaagaaataagtaagttctttgaaaccaatgagaacaaagacacaagataccagaatctctgggacacagctaaagcagtgtttagagggaaatttatagcattaaattcccacatgagaaagcgggaaagatctaaaattggcaccctcatatcacaattaaaagaactagggaagcaagagcaaacaaattccaaagctagcagaaggcaagaaatgactaagatcagagtagaactgaagaaaatagagacacgaaaaacccttcaaaaaatcaatgaatccaggaactgccttttagaaaagattaacaaaatagatagattgctagccagactaataaggaagaaaagagagaagaatcaaaaagacaataaaaatgataaaggggatatcaccactgatcccaaagaaacacaaactaccatcagaaaatattataaacacctctacacaaataaactagaaaatctagaagaaatggataaattcttggacacatacaccctcccaagactaatcccggaagtaatcaaatccctgaataggccaataacaagttctgaaattgagacactaattaatagcctactaaccaaaaaaagcccaggaccagacagattatcagccaaattctaccagaggtgcaaagaggagctggtacaatttcttctaaaactattccaaacaatagaaaaagagagactcctcactaactcattttatgaggccagcatcatcctgataccaaaacctggcagagacgcaacaaaaaaagaaaatttcaggccaatatccctgatgaacatcgatgcgaaaatcctcaataaaatactggcaaactgaatccagcagcacatcaaaaagcttacccaccatgatcaagtcggtttcatccctggtatgcaaggctggttcaacatacacaaatcaataaatgtaacccatcacataaacagaaccaatgacaaaaccacatgattatttcaatagatgcagaaaaggcctttgacaaaattcaaccccctttcatgctaaaaacactcaataaactaggtattgatgaagtgtatctcaaaataataaaagcggtttatgacaaacccacaaccaatatcatactgaatgggcaaaagatggaaacattccctttgaaaactggcacaagacaaggatgccctctctcatcactcctatttaacatagtattggaagttctggccaggacaatcaggcaagagcaagaaataaagggtattcaaataggaagagaagaagtcaaaatgtctccgtttgcagatgacatgattgtgtatttagaaaacaccattgtttaagcccaaaaactccttaagctgataagcaacttcagcaaagtctcaggatacaaaatcaatgtgcaaaaaccacaagcattcctatacaccaataacagataaacagagagccaaatcacgagtgaactcccattcacaatagctacaaagagaataaaatacctaggaatccaacttacaggggatatgaaggacttcttcaagaagaactacaaaccactgctcaaggaaataagagaggacacaaacggaaaatcattccatgctcatggataggaagaatcaatattgtgaaaatggccatactgcccaaagtaatttatagattcaatactattctccttaagctaccattgactttcttcacagaattagaaaaaactactttaaatttcatatggaaccaaagaagaggccgtacagccaagacaatcctaagcaaaaagaacaaagttggaggcatcacgttacctgacttcaaactatactagaaggctacagtaaccaaaatagcatggtactggcaccaaaacagatatatagaccaatggaacagaacagaacagagccctcagaaataacaccacacagccataaccatctgatctttgacaaacctgacaaaaacaagcaatggggaaaggattccctatttaataaatggtgttgggaaaactggctagccatatgcagaaaattgaaactggactccttctttataccttatacaaagattaactcaagacgaattaaagactcaaatgtaagaactaaaaccataaaaaaacctagaagaaaaactaggcaataccattcaggacataggcatggacaaagacttcatgactaaaacaccaaaagcagtggcaacaaaagtcaaaattgacaaatggaatctaattaaactaaagagtttctgcacagcaaaagaaactgtcatcagagtgaacaggcaacctacagaatgggagaaaatttttgcaatctatttatctgacaacaggctaatatcccgaatctacaaggaacttaaacaattttacaagaaaaaaacaacaacatcaaaaagtgggcaaaggatatgaacagacacttctcaaaagaagacatttatgcggctaaaaaacatatgaaaaaaagctcatcatcactggtcattagagaaacgcaaatcaaaaccacaatgagataccatctcacaccagttagaatggcaatcattaaaaagtcaggaaacaacggatgctggagaggatgtggagaaataggaacgcttttacaatgttggtgggactgtaaattagttcagccattgtggaaggcagtgtggtgattcctcaaggatctagaaccagaagtaccatttgacccagcaatccaattactgggtatatacccaaagtattatgtatcattctactataaagacacatgcacacatatgtttattgtagcactgttcacaatagcaaagagttggaaccaacccaaatgcccatcaatgatagactggataaagaacatgtggcacatatgcaccatggaatactatgtagccatgaaaaaggatgagttcatgtcctttggagggacatggatgaagctggaaaccattattctcagcaaactaacacaggaacagaaaaccaaacaccgcatgttctcactcataagtgggagttgaacaatgagaacatatgggcacatatgaacaatgagaacatatgggaggggaacatcacacatcagggcctgtcagggggtggggagcaagggtaggaatagcattaggagaaatacccaatgtagatgatgggttgatgggtgcagcaaaccaccatggcacatgtttgcctatgtaacaaacctgcacgttctgcacatgtatcccagaacttaaagtataataaaaaaagaaaaagaaaaaagaagaccttgaacagattctggttcttagtacggcattctataaattatattcgagttaattaacatagaagttacttagccaatttccaatattttggagcctcatttcggaggtatagttttgatttctacatgagccataaatatgtttatcattatatttctcatgctaccaaacacaatattatatgcatgaaacacaataaacaggttatgaagtaaatgagttactcttttaggagctctccttagtgctaaatgttaacacagtcgcacctaggagcaacatggcaaagatgttgatgatgatgattttgacaatgtattatgaaaggaaatgtacgcctgataatttacatgctcatcatatgtctctgtttgtttttgctgccaagaaaccctgttaccttagcattcagaaataccatctcttagttccacgtcttcagttatttctcatcttctaatcacttctcccttggtgccccactaatgattctactcagagtgtttagtgttgggagcatcactagcatccgagtatttcaagaactcgggaagaaggcacaccctcttgtaggcgtatacataaaattagtactcttataacatgcatttaattgacttatacaactcatgattcaactgcacagccgtcaccaccctggtcaggaggtcatgagttgagtttggagcacagcaactgactgcaagtaggctgcccctagcagggtttcttacagcccatttctatgatcctgaggacagagtagacaggggacatggtgtttcctgcattttcctagcagctggacagacttccttttgcaagataagctgtcagccacttgctgtgtggcacacctgttccgaggccacatcactcttgtcaaggggtggtgtgctcctcaccagcattagccacactctggagatgtgtagaaaactgtaactcagtaatatatacctgtgttgttgctttgttggtggttgtggctttattttgactgtaaaggacttataaaatggtgacatattaatgacaaactgtgtgagctatagcaaagcaagtaaccgttccatacctcagtttacctaactaaaaatatgagcagactttgactatatatgattcttattacagaaatgaatccatgaaccacacaaattattttttcacttagaatatattaaggtcataattttataggtaaaacatagcccgaatggctttgcctgcaactactcttttaaagacatcttttatgtaagaaatatagcaaccacgtgcaatatatggttcttgataggatccaagtttgaataaatcaggtgtaaaatacatgttttaaaaaactggagaaatttgaatatctgtcagctgagtattgggtgatgtaaaggaatgtttgttgattatattaagcatgaggaccatattgtgtttctgtagaaacatatataatttgtaaaggtatatattaaatatttatgaaagagatgccatagtgggtgtaattaactttaaaatattgcaagaagaaagatgaagcaaatatggcaaaatattagcaattgctcaatctacatgaagatacaggagtctttcttatatttaggttgaaccataggaaattgtcaatattagaccattttgacctaaaaacagtagttttctatggttcaatcttacactgatttcaaattttctatatatttgagtttttaattacaaattttctaaacatacatttgtctgtaaggaaactttcgaatacacattagtgtggtacaaagcttgtcaaggcttggtcttcagccccacttcttcagcagatttctttccctcccatgcatcccacccctagaacactgtggatgaatctttagttgaacttccttattctgaactgcttgatttccagaaactagccaagtcatttccaatgtctttgcttgaggtcttcctttcacccagcacatcaccctttctagcatcactctgacagccactgacattccaaactcagctcatggtcacattaattttgaagccatttctgagcctgcccctcccttagtcacttactctgtggtccccctatcaccccttatcctctttctcaggagaatctcccagttctcattatgtgacatggtgcctacttctttaggctgtttctttgtgatggaatgtattagtctgttttcattctgctgataaagatgtatctgagactgggcaattaaaaaaaaagatgtttaattggacttacagttccatgtggctgggaagcctcacaatcatggtggaaggtaagtaagagcaagtcacatcttacatagatggcagcaagcaaagagagagagagcttctgcaggggagctcctcttttaaaaaccgtcagatcttgtgagacttattcattatcatgagaatagcacaggaaagacttatccccatgattcaataaactcccatcgggtccctccacaacacatcagaattcaagatgagatttgggtggggacacagccaaaccatatcatggagtaagtcgcttaaatacaagagcagtaccttattagtctttgtggcttctgaaacacctcttactgttggaggctgatgctgaagggctgactttctacctgctctgtgccctgcagctgcaccctgctggcttcccttcccttagtggagctggcactctcagcccaggcacagtagaccttaatggatgcctgctggttgaatgcatatgcagaagttggttgtaactctgactaggtcttctttccacttaccacttaacatgcctctttctttgcctgctaggagataaaattaaagttgatgtgcatgatggtaacagatcccaggaagagagaggtaaatgcaaaaccaaagacacctgggagctaaaggatcattttcccccattgtgcctgtaatatattttggctcagtggaaataatcttgatgggctggtggttaaacaatagattatttgagtcctctttccagtttcacttcctccagaggaagttttcactgatcttaccacctgaaatgacctcttcctcaactgagacccacagttcctatgtatacccatcactgcactatgcagattgacaggcagatatgtatatgtaagtctgtctattatctgtctgtctacctattatccatatctatctatatatgtgcaataatgggtacacatctatttagatttagatttagatccagatatgtatgtatgtaggtatgtagccagctagctggctaactagctaaacagtacttgcatacaatggacactaaatttatatttgccaaaataaaggaagacaattatattttcatcagcactctcctagtatattgttcttggacttcgcaactctcataattcaggaatacattatgaaaatgaatcagaatgagggagatacacttcaaattaaatgaattaaattattatttaattgcttactgggataagtgctctgaaatggaagtacagagtgctgggagaatgtatcagtagggtctctaagatagactgggagccaggaaggagtatggcctctgtgagtgatgtcagaaagtcagatagggagggggagtagtgaatggagggcttgtggggccagagtgcaaagcctcctgaggaaggtgaccatggaatttatcacacaaactcatctcctatcaactatactgaatttgggtgctataaattattacaccaaaaaaaacaaatcaagattggatgtaaagagccagtaaggcagctattgcagtaatccaggaaggataagattagtggctatgattacaatagtggagatgggaatgaagaagtggacaaattgtttagaaggtggactcaacaagagccaactgagagacctaaaattcctcaggcgcttatcaggaaggaggcctgtcttttatatatcatctatctatccttcaatctatcttctcccagttaaagctgtaattgtggcaccaattctaaaagctatgccagtaaaaggagaaagagaaaaggccatccaaacttatagtgaaactaattaaaaaaaaaaaacaacattgagtaggttgggagctaaattctttgtaaggatttggatggcatgctaacaaatcttttactcaaggctctagaggatcaacttctacagattctttattttctctggattttagtgggggattttccttatgattcagttctatggcagtgaattgcatttctctccaaggctcctcaacaaacaatttacagtgtaaatatatttgttggcatgcaaatcactctgcattatgagtcttgattaatattataatgtgttgatgaaagcctgtaagtggttcctggaactaaggtttcagacaaagatgtgctgtttgggtgcagaatgtttgttgaatattagattaggttttttgttttgcttctctctctctctcttttaattttttttttttatttattttaaggggatgcttggtgtgaagtggcaacaaacttcaaaatacacaattaattagcacaaccaatctatcatccaaactgcacaaaaacactcctccccatgcacatgtcatgcttgatcacacccaagcctgcttttgtgtctgtgggtcctttggttcaactatttagcatcttgtttgttgccaacatcctgtctctagagaagcattgttctgtagtatcgcatgccttttaaatactgtgtgtgcatgtgggttgattagaccatgtgtctaattcccaatctgcccactgaaatgcagagatagtgttattgggctttgcttttgtgaagactggtttctcctcactaacagttataagcacatgtgctgagaaacagaaatggtggactctccaccttaagcaattcaagtattgactggcacttttctttcacacacatagcctgaataaacagcagttcagtggaggtctcatagatgcagaaaataagctgtgattatgagcatagggctttggatgccgacggaacttggttaaattccagttctgccactcaatagctccctgaccttggccaagttctcagaatttcagtttcctcatttggaaaatggggctaataattcctatttcttgaaattggagtgaagattacatgagatcactgatgtaaaatgctttcctggactaaaaacaacaaaaaggtgctaagtaaatggagactcttaccatatgcagatcctctgcctctggtccaccagtacaaagacaatgaatttagtatttgactgaaatctcctcaaggtttgtggattttatctagtggtctctaagcacttataatcaagtttctgactctcacccacactgcagcaccctgctgtagatggatctggggctggtggcagtgtttagagagacttagaagcattcagagcatctcaggagcagagtctcaccaccgctggaggagtggacaccccgggcaggaaaggagtaaaccaaaaatacagccagaggccacaaagaataaaataaggagatatagaatgatggaagatagaggaactgtgtttggtaaagaaagggacaggggaggttggattttgacccaaatgagagacttagccatgatcagcttttgttcttgatcttgaacaaacctgttcttgttccggtttgttcatgatcacattttgaagagacaccacttgataatattttatcttctatcctccgaacaacttgtgagttgctgcagcctctgggtagattatgttacccataaaattaatgtagattatccattcagaaacatagaaaatataccgtgttaatacccagaaggcagacctggaatgcctttggtggaagggtggggtaaatgccattgcacacattgcacaccagcctgggcgacagagtgagactctgtctcaaaaaaaaaaaaaggttttctttacaaagaatgttctgtattgccaaggcaagtatttgtcagtaggtcaggatttttgtttcagtaggttatcatctcttattttcttttttcattaaaatatcgtacgtggatttgtacagaatattcaaatccattgctagacaaatagttatgtatgcataagcaaaattcaataaaatgatcttcagatctcctatctttcctgtctctcctcgttcttgacttgctgctattttgctaagaatgtggttgccatcaaaagagagtgtgcacgcacccatgccaccatacctaccaagacaagtatgtttccttcctttatttggaatggacagccaccttggtttgtatagattgagcctccacctgtgctctggatcctgtttcctgcctcctgtggttgtcccttcctacttcctcagctgtctttttctattggactatttctatcagcagacatacacatgctaatagctttatattatataatttacttccattccagcccattggtggttaagttttcaatatataaattttagaaaatataagtatttagtccatgacacatatctattattttaccaaaattcccttaacaatgacactgatgacttctaccataatacattcaatggttaggctggtcttgaacccctgacctcaggtgatctgcccacctcggcttgccaaagtgttggggcaaaaccccgtctttactaaaaatacaaaaattaaccaggcatggtggcaggcacctgtaatcccagctactcgggaggctgaggcaggagaatcacttgaaccctggaggcagaggttacagtgagctgagatcgcaccatggcactccagcctgggcaagagtgagactctgtctccacataaaaataaataaataaatacaaataaataaataaataaacaaattcaatggttaaagtaggtttcactatcctttttaaaaactgtttcttcacttggacccaggggcatctaccacaatccctgcatttttccctaatatttttatttcgctgaattctcatcgtccaatacctaaataccggatttctcagagctcagttctgaatctcttagttctctgtctttactgtacccctgggtggcctcatccagcttcaggatattttaataccatatatatgctgaggacaaccacaaatatacatttagccctgaacaatctcctgaaatccaaacttgtgcattcaactgcctacatgacatctctgtttgaatgtctaacaggttttccaaacttaacttgtcaaaaactaacctccagggtctctagattgtcatacctctaccacccactcaaactccctgccaaccttttcctccttcagtctttcctatcgtcttggatgacaagttcattcttcttgttgcttaggccaaaattcctagttttatctttgactttccttttatatcttacagcctgtcatagtttgttcctgctactgtaagaaagtgccatagcctgagtggctaataaaacaataagaacttatttctcacagccctggaagctggaagtccactatcagggtgccagcatagtgagggcttgcttctgggcactgacagctatcttctcgttataacctcacatggtggaaagagagagctgtctggggtctcttttataaggacacaggtcccattcatgagggctccaccctcatagcctgatcacttctcaaagcaaccccctcctagaaacatcacagtgtgtattgggatttcagtatagaggatttttttagggaggagaaggcacaaacattcaatccataaaacactcaatatttaacacatcaacatgtcccaccaattctaccttaaaaatatatccagaatctgcacatggagctccttcacctcagccgccctgtggaagttcacacagtctctctcctgaagctgtgctcacctcccatctggtctttcactcacatcccctccagcacagatcctctccgcagaacaggaagagcaatcttgttaggacctagggcagcttgtgtttcttctccgctcgccatcctccaatgcctttccgtcttcttcagagtcaaagctaaggctctatgaacaggctgcccccctgcaggcccctccctcgcaccgctctctccttcctctccagccagcgctcaccttccagcctccccaggctttgcttctgtccaagcacaggccacactcaggctccttgcttcactctctattctattttcctacgttacttttcttgagaacaacatcaacgtggttctatttggttttgatttttaaatctaactctcccactagaagataagctgcatgatgctgggcactcttttgtagtcacggctgtgtctctagcccctagaacaggagcttacagaaagcgggcattcgatacatatctgtgaatgagtgagagtgtagaaagagaggaagatgcagtgaaccaaacaggattccataaacccagcaggaagcagggtcgatatggctaaatgaaatcaactggcttccaaaacttgtgctagttcgtgttttagtgtcttaacaaatcccctcaagtatcaaacccatcctaaaaccaatctgttatgataacttttcggaagaatcaatattgaataatctcaggctcacttttgctttcaacctatttttctctaaaaaaaaaaaaaaaagacaagcagctggaggataaaataacataatagaatggctaaaataaaagaatctattggagtaagatcaggatttggtgtaggatgacacaaactcttttaagcacttgcttactcaatccgttaaaatattatgaagccaggtgaggcaggaggatggcttgagctcagcagttcgaggccagcctggacaacatagtgagacccgctcccccatctctaagtatatatacactacgtcgccaaaacagcatattgcatctgccattaacttgcctggaatctgtaatttcttctcaacaaaaccagcaactctttcttatttaggttgatgtcattgtctaatataaacttctcccttctgagttccgtcttctgaggttctgttgctctttcaccggagtcactgagtaaaagatgcagtcaatcgcagtgtctgaggactgaggaagaggctctgggctgatttcacttcacgatgccgtctcccagtgggccccttttggttgcaaggttggctggtactggaagtgattcctccagttcctggagtcaccaaaatttctctgtgttgggatcctatttgacaaaaagctgcaatgatcttgagaacaaggccaactttaaggtcttccagaaccaggtccatctttcgttcacatctgtttcctttttcatggtcccaaaagaatctgccactcttctttgtcactgtgcttcacctgagcctacttattcccaattttacacggttgttcatgactttcactgcttcctataatacctcttagctgcttttctgcctctgaaaaccctaggccaaattcaattcctgtattgatttttcctgaatgccagctcctagttatctctttggttgctaatagtccttaaaaataagtctttcactttggaactttgtcataatctgttttacccttctatttaattattatcactataattataaaatcaactaataatagtaattctagttactattattaccctacatgcatcttgctcacatcatctcatttgatccttgtagtaatctgaggtaggacttaatgttgttaccattttacaggtaggaaaactgaggcttagagaacttgctcaaggccacacagtcagcaagcagcagagcaggtcctcgttctcagctctgggaagcctcgcaagccttgctcttaccacagggcttgagccactcttgcccttgaaggacagctctttatctcatgcttttctcttcagttctcagagtgccaagcacctggaagtccttaatacctacccgggagtcaaaaatgacaaaaacccacctctgtgatgctacgttatgaaatcatacctgccagaggaggtcctgtaggaccccctttttcagatcagtatcactgagatgagtgagttacaaaaggctggtctgaatccattttgcaggaaaaacctaatcccgacctctgactgtctcgtgggtgaggccggggaggcagcagtggaaataataggtgggattagacagacctgagtcagaaaccagctctgagatgctgagtgaccctgagcaaacaccttacccctgagacacagaggtggggggaggagtgggtataaacgccgatgagagtggtgtctcctcacagagctttgtgggagaataaatgagatgcttgtgtaagtcctgtgacatggcacttggctagggtggtgttccatattttcccttctttttgttaaaacaaacaacaaacaaacaaacaaaataaaaacaaaaataaccagaggtcttttacaaacagttcaaagaatggtgacaaaagcctcaagttctgtctgttgttagcagtggctctgtcctgagtgtgaaacatcacttctctccttgtctgtttcctggagccaggaaatttgggattggtgagacaagggaattttctgttagttaaaaaaaaaaaaaacaacaactttgtgaagagcttggggagggcaaaactggaggtgctgggcctccacagctgctcagagcagagccctgctgggcctgtccagctgtccccagggacagagcttcctcatctgccatctcaggagtggctcccttggagtggcagttggcaccagtgttcctgcccgctatgcaggcccatctcttagaggctgggaggcaggaggatcctttctgaaagcttctattgctatgtttctgctctgagtgccactctatcccagtcatggagccctttagttgaccctgaatgcctaaccagggtctcatagacactgcttccacctggcctgacacccgcctccttaattacactgcgctcacacattcaacgtgaaatagctctggaggctgcaccacctccaagagccagggaagtggttgggaagatggagaaaaaccctcaagaaagagagaaagcttaagaccattgtcctttttttttctttctttctttctttctttcttttttttttttttttttttgcaagacagcaatgccttttgcagcacttttaaatggttgccagggaaacagagcaagggagaggagaaaggttacatggatgctggataaagctaatgcaatttttcaaaacatcaactgacaagtgcttaaggctccagagcttctggtaatgtctcattctcaaagtttccctgatagagcctcaagtaccttgatatcatcattaacagtattttaatcgtttgtacactatagtttgtctccactgaagacttgtgctggtgagtttcatggaacatggtcttatgagacggctctttttgggtagttggaaagaagcggctggcatgctgaaccacaggttcagaagccttggcatgaagcagcatggctctgaagaaatcatctctagcttcctctccctggaagtaggaggacagtgactgaaatgcagccacagaccatgaagtctactgtgtgtgagaagatgtgtgtggctgtgtgagtgtgagagcgtgaaaaagactggtgcagcagtgagcctgccgaaagacatttctcccaggggtgtggttcctggatgagctgcctgctctgctatatcccgaatatttaggagctcgttcacttccttgatgagctgcctgctctgccatatcccgaatatttaggagctcgttcacttcctcgagcttgctcgtgaatgttgattcaaacttagtttcaccactgtggcctctagagagtatttataaccttggctctctgaagcattcccccactttatattttgggtgtcccctcagcatttatttgctccctttgtactgtattactttgcacatgcttatatattgtcttgggttcttacatctctgtatatttcctagtggagtctcacgtatggctctccgtggcagtgcctaatgcaggctaacttttagtcaatgcataacacatgctcaatgcctacacactgttctttcctcaataacaggcaaaagggtcttccgaacagatgagtattgagaccttcaatttggctctctgtatcaatgcttacagcagcctggctagcatgggtcatggctagaggtggagacaaagtttgaaatgagctaagaccatatcctcaggaaagcgctgagttgaaatactagaaagaaccagtttaagagaggtggacactggaatgatgtcctaaaagttcaaagttgggaggcaaaagtttcaaaacaaaagtaatgagggggagacagtgatggctggaaaaacttcagctggggtcaatggattgtctttatggacaagcgagtgcataaaaaatgggccaggagtcccccctgaattggcacagagtggttcagtggcttgcctaaaatctttcgaggagttgcaacataggcacgtattttctgtcttcaaattctttgtttatgtctactacctttgcatgagccataatatattttaaaacatagtgaatactaactgtgggcagaataggctaacgaagctttgctatctagaccagggtagacacaaatgccaaggatcacttagcatgagatgattagagtaggtacgcatgacacaaagcattatgctatgtataaggtccactgtcctggaaagactttctgcctgggagaacaatcttctaatgctgtcttgtctgctagaatgcgatctgagtttgtggcaagacagaaatgaatagagacatttttggcccctgtgtgtcacgtagatgctactgtgatataatgggaaacttttaaggctgcttttcacatgaacatggagggagacctcagcggaaagcaattatgatttaacctcaggaagacatccccctgttctgaggaatgtggtgtaaaatgtgacaccagcaggcttgattaatccatgttttaatctggattctaatacagaagtttggcttttcctttggattccaggaagagaagtagttatattcttctaatctgatcaaggagatgggaagggtcatttctttttgaaaagtattttaggaaagaaaatttcatgatcctactaattacttttgtgcaatttctaaaaatattttcaggcaaaaagatcttctgctctgatctaatcagatgtccttcccataatccttccttcctggagggtttctgagggaggtgtgaaaatattgacattggggatgggatgggaaatgcctctttatcactggcagttccagtttccaacatatcccagtgctaatctagtagagctggtatgcggtgtgcagtctacttccttttgaacctaagtctcaagtatttaccattttctgtatggttgaataatgaagtaataaccaacattatcaagcagggagaaagggggaacccaggaaaaagaccttggctctgctcaccagttcctgagcataatgtgaaagaggaagtccattcacgagcatgacgttgtcatgcaccagaaccctgcctgttaggaacatggccctatcatctgatcagtcacatagatgactccattgatcttgggaatacgtaagaatttgagaaggaagcagaaggaaaagtgggcaaagaacacatttagagaaaatgtttagtaggacgtattgtaatttacctggaattccgactcaacctgttttggatggaactaggtgtcttaacatttaatgttatagcataattgtacttcagtattttgaaggaattattatatatgtatacattatatataatgagtatataattacattatatagagtacttgtacattatatataatacttgtacattatatataacgtataagtatataatatatatatatttttattatacttcaagttttagggtacatataatatatattataaaaagtatataaaatatatgactatgagccatcacaacttttgcattagtagtgtcttggttggcatggagcgctataccaaaaataccagagatagagtggcttagatagcaggcatttatttctcctagttctagaggctgggaactccaagatcatggtgccagcatatctggtgtctgggaactccaagatcacggtgccagcagatctggtgtctggtgaagagccacttcctggcttgtagacagttgtcttttggctatgtgcttgcatgattgagggtgggacctctcagcctctttcacttcttaaaagaagactaataccatcactggaactccatcttcgtgaatttatctaaaccacatcacttctcaaaagccccacttcctaaagccatctcattggtgcttagggtttcaacatatgaattttggagagacacaaacatgtagtctttaataataactagtaagaccactcttgtgtcggagcagtgatccattggaatagtagccatgtggatacgactgcggttacgtcactgactgggtattcacagcatagaaaatcacatcattatctcacaccatttactaaaggaagtcatttttgaattatgaaaatgcttttatttattttttaatttttttttttttgagacagagttttgctcttgttgcccaggctggagtacaacggtgcaatcttggctcaccacaacctccacctcccgggttcaagtgattctcctgcctcagcctcccgagtagctgggattacaggcatgcaccaccatgcccagctaattttgtgttttttttagtagagacggggtttcttcatgttggtcaggctggtctcaaactccggagctcaggtgatctgcttgcctcggcctcccaaagtgctgggattacatgcatgagccactgcacctggcccgaaatgcttttaattatcctaatatgattttttaaatgaatgaatatcgaaaatatatttagaacaatgccaatgtccaaatgcctttagtgattagagttgaaattgtaatattataaggacttaagttatatggattaaagaacgattattgcatagtttcacagtccttggcatttttttaaagagccttacttattgcctcatttaattctcataacaattctcagtggttagaacaactatccttttgtggaagaagagtcgagtcatgccacttgatggacacgagcacagacctgcaccacgttgagctcatgtctgtatgattctcaggatcaagttctttctaatatcctaaagtgtcaaaaatgttttcaggtttttaacctaggtgtgctaagaaaagattcaggtatatgagtggggaaattggtttaccaatgagcctgtttagtttgtttcagaggtacctgatgatgggatatacaaagtctcagaagacagaggtactgaattgaaggctggctgggagtgctcacctcaatttgagagtctttggaagtgagtgcatgagacaggataagttctgtcaggctcaggatatactgggtttcaaatagcagaggcttccttaggtagtatcagttatgaggaatacagacatcaggaaaggtaagacaaataggatactgcaccctctgtcacccatgctggcacccagtggatgctggatttgaactttgagcttcacgtcatactgtcccttcatcacattgccctttaagcaagcaacttgagagtaaggattcggtgctgcataccgttatatcaaatacctggtatatcatctgacacaaagtaaacatttaataaatatttgttgagaaattgaactcataagtaaatccataaatactttggaataaatacagatctctggttgccaacttcccaggaaatgttgtagtttagaattgtgttcttgctttcataatgcctccccttcatggcctctgtttatttcttaaaaattcaatgatatgaaaattaattttgagaatattttaagaagttatggccccacagagatattctggcacattacgaaacagactttgggaatcactgacctagatagagtagcgaggtgataggtgctacataaatataataaattatactgagagggctccccagacctttctctcctaccagtgcagatggtacagaaatagtctgaagaaacattgaagaatgtctcagggcagaataacttaacaccttgggctgctttttctacccattttcacgttgttttatttaatacaaaacccattcattgaacaaacatacactaatggagtgtgtatgtttatgatatgccaggcggaagatgtggctctgagaaagtaacagtgaaccaagcttgcctggtcttcccattcccatggagccaatagccaaggggcaggggaggaccagacttaattaaaagagcacataaatagatacatcacagatacgttattgttagtttcactccttcagttaaaatgcaggtagtaagaataagtcagctctactcttagcatcttttcctgactatttatccttcgacacctgcttctcccttttctttctgtaccctctgactcttctaagcaatatgcacatttagaagtgacaggttagattcaaatactgatcaagttatatttttttcttttttgcacagggtgggggaaacagatagacacaaatcaaataacacctgcctttttttaagattgtactcctgtagtggaagtgcaatctgtttgtcgaaataggttgaataagcaaaaacgagtccaagtgactgagctgtaccaaaacactgatggggtccagagaggcattgattttgactgtactttaagacttagtgcatatttaattatgattataatgatgataagctagctttgggctctggtacatttgagagataacatcattcaggaattcagaaaataatataatgaacacaaatttttatcctcatctttccttttcaatcttcttatcacacactgtcttcccttgcctccaccccaacatacacaaatacacaacatcttgatcatctggctatcagctggtgggattttccaggagataattattaggttggtattatgtcccacccatgaaattttctgcatctgcagcagtacttttcttggctatagctggttgattggtgcctgtgggtagttctttttcagacatcacagctgtttacaaagtttgttccagaatactagttagggaggaaaaaaactttttcttctacccacttaggttcattgcctgggacctggcaaattatacggacaaaataaagacaaagaggacaaacccataaaaatgtatttacagaggcagcatgcaaacacgtgggaaggaacccagtgataagggacaaaagggtgcttgggacttgagcttctataacatcttaacaaagaacaataaatgtatagggaagtgacaagacagaggaaaagaggatcaggctttttggggtgacaaactgtgaggagataaatatgtggggaaaagtaattaaagatacaagttatttcagtaagatttgttatatagattctgcttggcgtcatttctgagctgataggagtcgagttatctcgggttattaagggtctaagcctgcttttacgcaaacgtgctggggttagcgggtgggaggcttttttttccatctgctgttgctcaattgttttcagctcaaaatcatctctatgccacgtggcatattttgggttagcatattttgatcctcttcattagtaacccttcttgacattctcacctttctgagagttcaatacaaggttgaaggtaccacatgctactacagtctttggttagtttggtttttaattaatgtaaaatagctgatttaactgcaaaataatgaagagacttaaaacaaacaactttcaataaaggatgagtcttgtgttttcaaaacaccaggagccgtaagtaactacagtatgacaaacagctctgattctacagaaccacagggagctgcttcctcacatggacactgtagaagggagcacagcccaaactgagcagtccatcaggcttgtggaggacaagctatatgttcctccaagaaggtcagactttcatgttacaagttttataagtcacaggacattctttatagaattagacattcagatattccttgatcacctcaaactgaaaaataaaatagcaagtttacactagtggaagatgtatgcacttgtgtgtatgagtgaagcagggagggtatttaaacttcttagaccaaagaatgtaatctactcttcaacagataagcttgtaaaactttctggcacttaggaattttctggtcctaagcatgaagtacaggcgacattatacaattaaaagggtgtactgcaaaagaatagacatgagttttgaggtttggatcctggcttcactagttcttcattattcaaatacaggtaaggcgcttagcttctcagcccatgtctccttctctaaagcgagaatagcaatgcttcccactctagcgcaattcctgcctgatctcagtgcatgctccctacctcttagctttgtccagagcagagctatctaggtgtcctacagggggagagctaagtgtctgattaatattgagcagttagatgagggaagggagacagtggaagactgggggcgatttatagaggtgaaagataggaacaccccttgacttcattctgagcgtagagataccaatggctttgctccaacaaatgccactgtttccacttttgatctctggttgcccaactctctttctcttctttcccatttcactgaatcctgtagcatctcatagtttattctaagactataccagaataaggaataaatttgttttgttgctgtttagaatgtccaagggcctttttgacccagtaattttacccaagaaaaattttcatgaagaaattgttcaaaagtagaaggaagctctctacacagcatgatttttaattggagaaaaagtaaaagtaaaggtcagcaacatgggaatggctaagcaaattatcctatattcattcaaagagctattttaaatagaaattatgaagaatatatagtatcacataaatgattatagtagaataattgttaggatggaaattataaatttttcttatgttctagttatataatcattctcattcatgtatccacaaatattagcacatacaagatctaatagactatatgatgtgtcgaaaagttgggatcgtgtgatttttcatctctattgtctttataactgctattatatttgtaaaacaacaaaaactctggggaataagtactacgggacaaaaaactgcaacccaaggattaatcttttgcccttgaaaaataaaagaggtgtgagatctctgtttggaatctaattttactacgctttctactctcatttttataaactttgacctccttgcaaaccactaacctgtagttacggaagaatttggagactaggcagtctgttctttttatttttttccagtcacattactaaccaggagacaacagtgtccacatggagataattcaacaccttgatttgagatgttctcttcatctccaaggaacaaaatccacttcactttcatcattcctattccacgacaacaaactgaacatttcatcatcagggaattgtaataattatctattgctatataccaatgactttgaaaattatcatcttaaaataatcataatagtctcatcatctcagtttctgtgggtcaggcatgcatgagtggttccaccgggtggtcccagctctgagtctcaggaggttgtagtcaatatgtcaatggggcagtggtcataagggcttacctggggctgaaggatctgctcactagtgccttggtaatttggcattgaccactggcaggaggctttaagttcatatcatgtgtccctctccataaggctgtttgaatgtccccatgacatggcagtgatctaagaaagagatcatggtagacacttcaatgtcttttatgatgtaacttcaggagttacccactgtcaattcttctgtagttcactggacacacaaatcaaccataattcagtgtggaagggttctgtagtggggcataactgccaggaggcaaggatggttgggggcattttagaagttggccatcacagttcaccctctgtcccttaaccattcatattcctccaaaacgtaaaatgcacttaccccctcccaaagcactgaaaagttttaccccattacagtgtctgattggaattcagaatctcatcatttacatcagttctaggtgaggatgatggtccttcagtgtgcttccttccatatagccttgagtagcttctctcaatcagaaaacctaagaactgaagagacagtttttcctgctctccccaccacacacactggcacacatactctcacacacattcaacatgtcatagaaggacaggcatagcataatcactgtcaattgtaccattcaaaaaagaggacaacaggatatacataggagttgctggttcataataattctgaaatccagcaaagtacatattgacagttccttgattcagacacaaggcctgggctatttctccatggttcttagctctgtcgtctgggctcttgattttaccttctcagtcattttttctttccctttaaaggcagtcttgttcacaactgagtgtttctttttccagctgcttcttggatgtagatgtttgggcatccaaagatctctttaattttgtaccatctttgttttctttcaatccaatctgacaggatatctgtcaataaaatccttttgtggccaggtgcggtggctcacgcctgtaatcccagcactttgggaggccgaggcaggcggatcacaaggtcaggagatcgagaccatcctggctaacatagtgaaaccgcgtctctactaaaaatacaaaaaattagtcgggcgtagtggtgggtgcctgtagtcccagctactcgggaggctgaggtaggagagtggtgtaaacccgtgaggaacttgcagtgagccaagattgcaccactgcactccagcctgggcaacagagtgagactctgtctcaagaaaaaaaacaacaacaacaacaattattttgtgagatgtataggtcccttgtgagtattactgaggttcattttattagaagaaaaaatattcaaagatctcttccagagaagtctttgtctatcttgggtttctgcccttagacaaacttttaaacttctaagaagccctgttgtcttactgaatggttctctgaggcgccaacctaaatctttctgagatcttaacaaaagatttcacaactacactctcggtttaatgtctaataccaagtttgcctgatagtttcctaggctatattttttcccagaagctattttttaaaattttactatcaagcaccatctagagattctgggagtattcaaaaccagtacgctctgggtcctttatatttaaaagtgttttctctagttcatctctcattttagtataaaaagcatgaaaaacttaggtacaccttcaactctgcctggaaatcttatctagatcacctagttagatagattttgtacttttatatgttgcaggcgatagttttgctaagctttctgccccacataataacaatcacctttctttcagtttccagtgacatttttttcacttttctataaaagatcactcattaccttctcaagaaccattaggcttatgctaccagtctctttaaacttatttaggctttctgtaacattcatcaatatcctgtagcctttgcattgtctgtactttacgtttttacagtcggcaacacctcttttctaggcaccaaattttgtattaattacttattgctatgtagcaaattactcccaatccatagtggattaaaaccacaataatgttgatctcctacaagttttgtgggccagaaattcaagaataagttagataagtgtttcaggcttgagtttctcatgaagatgctgtcatgatgtctgcatctgaaggtatgagtggaactggaggatcagcttccaatgtggttcactcatatggctaacaactggctgctggctatttgtaggatgcctcagttccccacattgtggatttattggtctgcttgaatgatttcataaagtggtgtctggcttcctccagagtgagtcattcaagaaataccaaggtggaaactgcaacgccttttgtgatgctactgtgggagtcagataccatcacatctgacacatgttactggatgcacaggcctctctggattccgtgtaggagggatctacttaagaaagtggggattgctgcagaataagggaggcatctgggggcctggctatcacaaagattctttatcttaaaatctgaagctccattgtgtgtatatgtgtttcctatcatttactgaatatttaccatatatcaagaattatgataagtactttagataggttattgtatctagtcttcataaaaacactctgagataaatgttattatcccatcgtacacataagaaaactgagtcacataaaatttaagtaatttactcaatgtcatacacctaggcatggcaagactggaatttaattttaattcaatgtaattcaaaatcttgagattttaactctgacttgatactgcttttgactgtctcatatgttccctctcagtacacctgccttcaactttagagattcctagtcctgttttctcccaatctgtcagcatctccgtgggctagtttcttttcttacccagctcatctcatctctttctcagcacacttttctctcttttgtaacctttgtgttttccacaacacttaccacggtggatcaatgtgacactcaaattctttgtttcatacccaggttactgagctcaggtgaagaaaatgtcacacattctggatttgtgccactactaatgtgtggtctctagctccagctgaacctcaaaaggccgcacaattatttctatctttgaccacatctctttcccattcttaggattaccattccaaaccttcactatcttgaaccccatcctacccttttcaatctcagcaagtagaatgatcttctaatacctctcagctacacacatatatccaatttatttccccctgtttctaaatattatgtgcctcttagcagacaagcggaaatcttctgcttgttcttttaatcctcttttgctcatctactatgggtcattgctatatgaattatctcctttgtcttgtatctatacctcccttcgccttcttactgcctgctctctcctttccctgagtcatgtggcttccatgactttaactatcattctcaaggaaatctttagccaaggcttctgttttctttctcagtcacccatctttgttaaatgttcgctcccagaattatttcatcttcgtgatgatttttatctttttgtgtgtttgtaataataaagtaaaacatatcattgagataatgtgaaaagaaatgaaaatttataacaaataaaaagccttcactcaccaccttcccactgctctatctcatcttccagagaaactatctttcaatatttagtgtgtctccttttaatcattctgccctcaataatactactacttctgtgtcctttcctcctaagccccagatacttgccttctgttcttcaggtaaattccaccaaggcttcttccgtagtggtcaccattaatctctaaatactgaattcaatggacatatttcaacctgtgtcattcaagacttttctgctttatttcatgcagttcaattgttctctgtctcctgctttcttataacctaacaatctctcttggtttgctgtccatttggggcctttctttcaggtctcctttctggatttctctccctgaagcctccccttacacactggggttgtagggtgccagcttttttcctcactgttctctttcatcctccctgagaattcatctttatcatcatcattttaactaccgtttcatgatgatgactgttatagccacatctccagtgaagaccactctctcaagatgtacgcatggaaatatctgaagcaggaacctcagactcaataccctcaagataaacccatcaatacctccccatttactactttgtctataacccctttctcccttaacaacaccacaatctctcttagcaagtcttgtcagaaacctgggatttgtccacgaattttcctttcatttatcccccacttaggtgtatgacttagttgtcattggggaaggtagatttttgtcttaaatattttttgaatcattcacctctcttccaacttctgtagtagtgacttaatttaggtccttattattcttgttcgaactttaaaaacatattctcctaactagtatgtctgcctataaacattctcccaccaacacttgctctgtctcaccatacatccccatctcctccaaaacatatagaactgataattctctttggacacagtgttctctttaaaataatacttattaaatccatgcataattcctcatgctgtcagcaaactcaaatccattctcttagtacgtatggtatataatatgatcacaccctgtaattttttccaacctcacctttcatacctctttcatatcctactacttctacctctatttaataatcctgatacacctatttgctttgcatttcctacatgcagttgacaattgtatttctttttgccatgacttaaattgtgttatctttctagaaggctttccttagtatccccaaccctgttagctgcttattcatcttcaagagtcaactcaaaaatcgttaacagtctaattttctggaaaatcttttcttaattccccatcatagttagatgcccctctgtggactaacgcaacacactcaaatcattgcaagcctaacatgaagacccataaccttacaatggcctcaaaatgcacccagaatgtagtgggtgaattatataaatgtgccaattttagtggatgagttaacatatatagacataactcaacttttgatcatagactggcttatctttcatagtctgtaaggcaatacactgtggcacatttctttgtcttagtcttatctaagagaaccaagctttataactctttagactaaggttgacttggattggcatcaccatcagatttattaggagtgttacaaccttctagaaatttggagggtctatttggtttgggtccatattcattcctaaaccactcattgtcctgactttcttgggtcctatgctgatttttgagtctttagatttgtgctgccaatgcagtagccactagacatgagtgactaataaatttaaatacacattaattaaaattaaacatttgctttcttaatcaccctatccatagttcaaaaatccaataaccatatgtggttaccccactggacaggacagttgatggaacatttcattatcacagaaagttctcctgaactgcacagctctagattcaaacaacaataataacgaagcagacagaacaacaaacagatgaaaaaacatacctttttcttacatcaagagctgtttttctaggttcaagactatcctgagctgatccttccaaatcctttcttcgcatgttcagtttgccagactgatattcaccagctgattttccttctacaaatacaggcttcatgtgatgttataagccagcttttggatttaatttaatcttcttggtggccaactggggtcttggtggtcaagcagatttcaaccactttctgtccacaccttgtgcctgtcttagtttgggctgaaggacactcacatttccagctgatttatgaagcagagattacgtcttcttttgaggccagtaaacattctaacatcccctggtccaggttatcagaactgctctcttccacagagaattgtccctttgacagtttatcactcaggtgcttctccagggggttatcttcctgagttccatcaccacatttttatactatcaaaattacattacacagagaagaaaataattgacatcgtatttatcaagggaggatcagagctattttcccacacccgctattcttcatttccttttagattattttagccaattatgcctttttattaagagaagattacttgttgtgtctttattttgtggttgtttccactacagttaattaatatgatgccatggtcttaaagaatgtctagtatatggattgatttgtgttatttattaatctttattttaaatagtcaactgcatttggtacctgttacacctttagttaggctgcatagaaatctctactgaaaatacaaaaaaaattagctaggtgtggtggcgggtgcctgtaatcccagctactcgggaggctgaggcagataattccttgaacccaggaggtggagggttcagtgagctgagatcgtgccactgtactccagcctgggtgacagagcaagactctgtctcaaaaaaaaaaaaaaaaaaaaaaagtcacatagaagactgcattggtaaacaaaatccgaacccttttctcaaggaactcagtttgttgtctttgtggtgatgactcagaatagtctgtcctggaaaagcatccctttggtgccatattaagtaagttctacttgcctttggtagaatatcctgctcatccccttcatgtgtacctgggctggcttcttccttcctgtgtctcctgacaactgttctcactcatcaaccaacaaaggcggtctgatgttttctgacaaactccacggctgtcctgcagaaggcatttgaatgcaaaccacatggactaagaatgtaatcttaaggcgttaacaccagccttttctcattctggaacccttttgactgagtagatgcaattgctgcaaagtctttcccattgggaaagtgtgattaaactgtggctgctgaaccttggatgagcaaaggagacagacgatgtacctgtctgggagttccagaatacacagctactggagtaacattaaggatcttttggcattctgttcctgacacaggtgtgacttatgctcaagtttgaccagcccgtttaacctttgtccaaccttggaagagtgtgtgtgtgtgtgtaaaatctataatatgggtgtgttcggttttcacagatccaggacatcatgagatagtgcagctgaatgtgcattttaagattagttaaacatccattcatgagggctttaaaaaaagctgcctgggtatgtacaatgtatcttgcttttacttgagctctacaaggatgttgttaaataaaatcattgtgcataatgtgaagtgacagtgagtccaagtgagtccacagaaagttcatttttactctcatcttccctgaggctgctacacttctctcttccatcggtggcatttgagaagagtgctacttcttgaccccctaaccagcctttctttcacattgaacttgttcactttccttttccttctgcttttattttatctcctcctcgttcttctcctccatctcctcatcatcattattgtctttctcctccatctactttcttaattttttttcactggggcccagcattggggtggtagaaagagcacagacctggcagtagtcaaaattgaatgggcatctactcagctacatatttaattcaggggaattttgtaatttttctgagtttgtttccttgtttccacatggcatcaggaatgtctacctttcagtattattatgatgattaaatgagttcacatgggctatttacatcatagcacataaatcctgttatatttaattaattcagcaaatatttagtagcagctactctatgcctggtactattttaggcacttaggttacagcaggaacaagttataccctgtcaccatggaggctgtgttgaagtagggagagaacttcaaaaaccaaacaaatcacaagtgagcaggtgattaaaaaaaatgctagagagaaaagtaattagtagcaattagtatatactgttattattattgattttattattgtatgttatcttctggctggcccctctgctattttcctagctccatcatcttttgtctcttcttgcagctctgcacacccaaacgatgccttcacagtgattccagggcctcagattccccagtgagttgacatgactccgcttgaaagagagatcaaatacagagaaggaatgatttatgagactcctgtcacccaggcaggacactctcagcatatcctcaaataattcgcaactccctttctgcctggggctacaggagcctggccaggggagacagggtgcgggcgctgtccggggtgggcgggctgcgccggcacaggtgttcccatggagcagccctgcttgttacaggcgcggcacacgttttcgtctttcaccagtttaccctgtaaatcaaacgtccatgctgttcttgaagctccctggtgagctgtgtggtaaacctgtttcttcctccctcttagccgtggaagggaacttctgaaggacaaaccccactgcccttcagatctgtcccagcttacccggcagaggagctggggaagcccagagctgcgtgcaccaagggctggctcaggatcttggcctgcactcggccttgccactgctgagctgtcatattacacctagctttctttttaagggtgaaattttttagaatagggaactaatcctcctcaggagataatttcatagggctgtaggaggatattttattccatgagtattttcccgactggagattccagagcagaagtgccagcccctgggaggttttaaaaatcccaatgcctaggacctaccctaggccaattaaatcataattgatgggcatgggactcgatgtcagtatgtttttaaagacgcctggatgattccagcctgcagttgaggttgaggatgactgtgctgggctctagggctccgggtgtgccaggagagcagctggggcttccgtttatgcagcacacaggaaaggcccatggctataggggtgacaacagagctctttcctccccaggagagccctggctggcacagaggaggcctccacgcctgtttgttttctgaatggacagataaatggagaagcccacaagttaccgggagaaatgaggatgggaacctcggttcacctaaatctctaggcacaggtgaaacgtcagatcacctagtattgaatagcagggctttagactcagaatacctgggtttgcaatccacttacctaaccacgtgacctcaggagagcgaccctacctctctatgctggttttcttctctgtaaaacagaactcttcatagcaccttctccagaaggatgagaaaattagttgattgatgcgtatatatagtgctcatgacagtgtctggcacaagtgagtccccgataaatgttagcaatcagcgtagtgctaagcattgatgaatgtgcagtgtgtgtgaggagcttcaggagcacagagaatgctggactcattccgcatggggtcagggaagggtccatagataaaagacattaaaacggagttttactgtaggattattttatactgaacaactagaaaaagggaggggtttggtaggaagtgcggagggatgggaggtatttcaggcacatggaaccatgtcctttacgtctgttggatgagcggtaacttaaagtaatagaagcaggcccaaatggccttgcagttttttaacgcagataaatccccatcctaactctctgcttcctcttccacggtcctgcttctggaccatggcggttggttttcctagccaccatcctgccagcccacacacacacttacgctgcccgctcaactctttggttctacaaggaatcagttcaatatttcttttgtaactggaaataatctctcaagctacaaacttagactaagtcttcaaaactgtaacctcattattatgaggttttctttaaaaaaaaaaaatgttgatatggtttggctgtgtccctacctaaatctcatcttgaatttccatgtgttgtgggagggacccagtggaaggtaattgaatcatgggatcaggtctttcccatgctgttcacatgatagtgaataaaagtctcatgagatctggtggttctatgagggggagattccctgcacaagctttccctttgcctgctgccatccatgtaagatgtgacttgttcctacttgccttccaccatgattgtgaagcctccccagccatgtggaactgtaaattgattaaaactcttccttttgtaaattgcccagtctcatgtctgtctttatcagcagcataaaaacagtagagtggggcgctgctgaaaagatacccaaaaatgtataagcaactttggaactgggtaacatgcagaggttggaacagtttggagggctcaggagaagacaggaaaacgtggcaaagtttaaaacttcctagagacttgttgaatggctttgcccaaaatgttgatagcaatatggacaataaagtccaggctgaggtggtctcagatggaaatgaggaattttggggaaactagagcaaaggtaactcttgttatgttttagcaaagagactggtagcattttgcccctgcctaagagatttgtggaactttgaacgtgagagagatgatttatggtatctggcagagaaatttctttcttttttttttttttttttgagatggagtctcgctgttgcccaggctggagtgcagtggcgtgatctcggctcactctggcagagaaatttctaagcagcaaaccattcaagatgttacttgggtgctgttaaaggcattcagttttacaagtgaagcagagaataaaagtttggaaaatttgcagcctaacaatgcaatagaaaagaaaatcccattttctgaggagaaattcaagcccactgcagaaatttgcataagtaacaaggagtcgaatattaatccccaagacaatggggaaaatgttctccagcacatgtcagagatcttcgcagtagcccctcccattacagtcccagaggcctaggaggaaaaagtggtttcctgggctaggcccagggccccccctgctgtgtgcatcctaaggacttggtaccctggatcccagccactctagccatggctaaaaggggccaatgtagagtttgggctgtgatttcagagactataagcctcaagtcttggcagcttccacatggtgttgagcctgccagtgcacagaagtcaatatttcagaggatgtatgaaaacgcctggatattcaggcagaagtttgctgcaggggtggggctctcatggagaacctctgctagggcagtgcagaaaagaaatgtggagttggagcccacacacagagtccctactggggcactgcctcatggacctgtgagaatagggccaccatccttcagaccccagaatggtagatctactgacagcttgcactggaaaagcctcagacactcaacgtcagcccatgaaagtggctgggagggaggctgtaccctgcaaaaccacggagttgcccaagatatgggaacctaactcttgcatcagcatgacctcgatgtgagacctggagtcaaaggagatcattttggagctttaagatttggctgccctactggatttcagacttgcatggggcctgtagcccctttgttttggccaatttcttccgtttggaatggctgtatttacccaatgcctgtacccccattgtatctaggaagtaactaacttgcttttgattttacaggcttgtaggcagaaggaacttgcattgtctcagatgagactttgtactatggagttaatactaaaatgggttaagactttgagaaactcttgggaaggcatgattggttttgaaatgtgaagacatgagatttgtggggtgcggggggaggacaggggtggaataatatggtttggctgtgtccccacccaaatctcttctcaaattccaacttgttgtgggaggaaccaggtgggaggtaattgaatcatgggggcaggtctttcccatgctgttctcgtgattgtgaataagtctcacgagatctcatggttatataagggttctttaacagcagtgcaaaaacagactaatacatagaagaacttaatgtttgtctcatttccattatacctgggggcaagaatttattcttagtcaattctgaacgaacttgatcaggtcagcattttctctctctcttccagggtgtcctttatgttttggggaagcttgcttagtgcactgtgctaaagaaggggtggtgggaggtgggttctgtcccattcctggacatgctctgacctggagttgccctctgaaatgcccttgtgctagtgtggtcttgagtaatgacccacaatttccctatgccactctgacaggcatctatgtacccctgctcagctatttcacaccagaacaactgggcagttctcttgaaaagctgtgtctggctgtcttaggctttatttgcttaagaaccccacatggccatctctgccatgcacctcaaggcctgggaaccaacttcctctgcagattttccacccccttctctctagccaagggatttttcattttccctggagcagaaggaaagggctagaggaccatcctacttccagaaataatttcataaattgtgtccaccttagaaactctaagcccatagattaatgtatgtgatttctcttcacatgcctgcagttaacaacagtgcctggagggcataggcctggaatggctttgctgcctcaggaagtgggcaatgagaaagagaaaggagagagaagggaagataaagcagatggatttaataggggatgaaatataggtaaaaattcctaaacattattctatgatacgtttcattaaaaaaaaatcactaaaattaccgaatgtttaccatatgacactcttcactaagcgtttatttttcataactggctcttctattttttacagtcaccctcagaggcaggtatatattgtggggttcagaaggagtgattaaccgacctatattatgtggtgggaaatagcagagcccagatatcaccccaaatctgcttggctcaaagcccatgctcttacccactctgctgtaatgcttcccctcacctaatgtgtgaagttatgcaagaacacaccatatgaatgcttaaaaatactattgaggagcttggcattaatatacggttttggtgagtaaatgggtatcttaaatctgctatggttgttttttatatgaaaagcatgctgtggcacatacccttgaaacataaataaccatttcctaatcacatggccctttgttctcttgtttcttcagtggactttgtatattgggttctgtctaggcaaagtgcattatcaggttctctttttggtctagaatgatccattttctgtgtctgagcagaggcagctccagaatatcatctctggggtcagactggtctgttccaatcaacctccatctctcactgtccccttgatactttttcattgaatcataggatatggagagtactgtgtgaaatttgtgtgaataaagataaagcatataaagtgagatgacactttagtgacactgaagcaatcgtgttaaaacttcacctttcgctgcaagggccagcctgggagatctgacctctcacttaggatctgacctcttctacttgatcctgcccagttcatggagggctggcagttgacccacgggtctccctcctactgctaatgcctcttgataaataataaggagacatgatagatagctaccataaaaaccaagcatatcaactaacgatgatgttccaataatctagtgagctcctccctagaaactgcatacttcttgagtgtggacttaacatgtgagaacaggctgcctttgtccatcacaacttgtccagctcagctgtcatttctgtggctctccctggagtgcagaaaaaggagagtgctagctgattgcaataactcatgttcttatctctttagtttttcatttccttttgtttttataagaagaagaatcaaccattttagattagcatatttttaaaaaatgcaggtagcttcttcaccagcctgcatcccctctaaaaaacaactttataaaatggatgtggtgtgagtttagatacctgttagaaagaagtatgaaaaaaaaaaataggccggacgtggtggttcacgcctgtaatcccagcactttgggaggctgaggcaggtggatcatgaggtcaggagatcaagaccatcctggctaacactgtgaaaccccatctctactaaaaatacaaaaaattagccaggcatgatggtgggtgtctgtagtcccagctactcgggaggctgaggcaggagaatggcatgaagctgggaggtggagcttgcagtgagccgagatcactccactgcactccagcctgggcaacagagcaagactccatctcaaaaaaaaaaaaaaaaaaaaaaagggaaggaaagaaaaaatacattccctttgtttcagcacataaacagctccctcttaaaaggaaatccaaatagtttcaaacaggttcttgtttttagtcactgatctttctctctctcctttccttcacttccagatgtcttgaaagccgaggctatttttgttgcctctgcttcttattttcctattcagtcttcgtcaacagcagtccggtttctaccccaccactgcacaaaccacagacttgctaagactacctatagtcatctcaggtgtggacctccttgtttcatccctcatacttccctcgtgcatttatccttcttcctctcaccagagtaatcttttcaaaatgcagctgaatcgtaacacttctctgcttaatattctgcctgggtacccagctcccagagatgagtttgcagcccttcacatggcatctgaggtccttgcctcttcccgaaagcacgccttgctgctgggccacctgtcctcacatgccttgctggtccctagccagctgtgaccccttaccaggctgttcctccgcagagcttcaagcatttatcctgtctgctgattctgcatgtggttttcttgtcctccttgtctgctggccaaagtaaagacttatctgaagcatggcctcctccatgaagtttcccaactcccctcagcatgcagacatccaaaacatgaatatgacagtgtgcgtcacttcacactaactatcctgcaagacacacactccagttggcttggacaaagttcgtttctcagctttgtgtctccagcattgaataaacaccctggcacataatgttgaatgaatgaatgaatgaatgaatgagcaatcaaaccatatttatatcctaaaatgtcaatccatgtgagataatgtcaagagaagaaatggggattctgtatgagggatttagaatttaaatttaattttaaatgattgctggctaagttatctaggagcatcattttaattagtttatccagaattataagttgtaattttgccttatgttaaaaaaaactctatgtaaagctattagggaaaaaaatgacaggcatgtgttgaattgtagttatgaaatagtctatgtacacaaggtaataatattattatgtgattttaagaagaattttataaataggtcaccactgactatactgtatctccagctaattttctttccagttttctcaataattggatcctaggtcagtctttagctgtggaagaagagctgacaataaaatagacatttagaaatcatctctccataattccatccagaataaattcccgggtaaatagcgagccaattagagaaatatatatatgctgatgaggttttgaaagctacaccagtgaactagtggagacttttaaatgcctggattgatcaggaactttgaattgacagcctctttttggcaaatgcagtttttaactgcaagtagcttcttccagagactttaaaaagaatgtttggagaaatgagtttggaatttaaaatggatgatcatttatcttttccttgcactaagtagtcagtaaagctgaggcaggccataggaggccctttagagctgctcaggaggtagcccacaacgacttgggagagagggctgtggccaggtcttggccggcaggctagctcctggggtacagatgccatcagatgttttgactatggactgtggctcagggcctggtcttccatcctatcaggccaaaacatgactttaccaatgcatgcagagctgtgcagtctctctcgcatgggctaaactcacagagattgatgtaaaatccaaagggctcattcatttatttgttatgagatatttccctttccagtgcaagcattttaccggcacacttagtagcagcataagttttgtgccatgattatgccttctctctgctggtccttggtggatccagggagcagaagcaggtagctgtccccagatgactctagttccaaacggtttcgcacatgagacatctgtgtgggctaacccacagccttcctggagtgcatgtggagagaggacacaccaggctgaaacttgcactcggagctcaagctcatttgtgcagcaactggcagaacctggcccctgcctatctgtaccatctggagaagttgaggggcaactcatagaagctgtgtttaggagaagacacacatttctctagctttttatttcaatataaagggatttctgagtgtgtctgactgcttgcctctctccctatctcttcctgacttctcctgggggaagaagctgttctcctgccaggggagcttgtgagcaggaatctgcctggctgaaaatgcaccccttctggttctccttggcagcagcctggccgcagcacacagacatcctggtctgctcgtggttgcagcacagaggcctgcctgcgaccacattgttaatttaaaccggggagaagtaagggaaagccctttgtaccgcagtcacacccctcccccatgtctggagcagcgttgacacattgacctcaggttctcgtcagtctctcaatgaatcctgaactcagaagaggagagtgttacttataccctccccaacaccaaccaaaaccaaacatatgaacaggaaaacaagccatttaccacacaggatgtgccttcgccactcacagagcatgacctatttctctgtctccccaaacgaaaacgcggaaggccacctgtcctgactgcggtagtgtctgcatgacagaagaacacgcgcctcctggacggcgcgcccgggccagagagccagtgcctgtcagtcagggaccctccaccctgcttcctgggccctctccttgcagggctcccttcccttctgtggcatcgtattttggggtcagccttgagagggctgcagttctctgggagatcacctctctgtgcctcagggagggcacgattgaccgtaaagccatgaagctatgcttctgtctctcacttcctttccagaccctttggagatctggcgaggagccctagcaacgtgctcagatgctcatctgttgataaaatttgtaaaataggagatgtcaacccagggagtcactgtctctttcccttcagactctgctccttcacactcctttccctttcctgaaacctggggctggagtaggaacacggggcttcatttagtaaggacgtgtttgtgtgcccgcgtgtgcttccctgtgcagtgagagcattgctgtcctcactgggatgaccccagaagcacacgtccactatccacagtggtgtagctaccctagccacataggacacgtatggacacgtcagccagcgccttgtgcaggagctgtgcagggacacagaagaaacaggctgacctagggaactcaccccaccgtcgtgagagtaaatccaccagtggatggctcagatcttacggatgcctggtcctaagggatttctctcttgccaggtatacacatgaccgtgcaacacacacagttaaaagcaccccctacagtgttttaagacttgtaatgtggtttattttatcattctaaatactcattttgaatgtaatttagccctcattctttttctcgaaagaactcaccccaagttgtaaaagctgcagataccataacacctgaacccaccactggtgctacaggataaaatttaaatcacgtctgctccacggcttgagctcgaggagaatctcctgcgagtacagagacagcgcaccaagacccaggaggaagccagtgaaagaatgtgaaccaaattggagtggagacactgagcctgagataccgagttggctgttggcttgaaaagaagcacgtctcatttctttggttccccagctgggctgggagatgtggtttgctatcactgcaccttgacgatggtgtggaaagggaggtttcctgcaccctgtgcagaatgcaggaagaaccacaggattactcttcagtgatggttgcagggccatctacctgttctctgtaaacttgacggattgaagatccctagcgaatgctgtccttgcctccatacacagcacagcttattgacttcagtttttgttgtctttcaaaaaatcgcagacttccaaaattaaaactgtgtttccctcatagagagggagacaccataggagggaaagaacctgctttgtgaagctgtcccttacctttcaactagatacatttttcaaaggctcttcctttctttctattttctgagtttgattgtttgtttcggataagggaaatttaacttttttaactacaatacgatatatgttaatcttagaaaatttgaaaaatatagaaagtatggagaagaaaccaaacatttctaataatcccaccacccagagatgacgactgttaaattttgatgtgtttctgatcagttttgctttatacatgtttgtttcctttgcatagtggcagtgatgtttgcatactatttcgtatcttgtttttctttcttctgtggacattttcagcttataaaatattgcttaaaacacaactgtaatgcctgcataatattctagaacagtgccatgcttctttaagtccacgtctgttattaaatattagggtgtttttgttcttccattattaaaaaaaaattctggtattatctctgagcattaatttatattcccacctcagattatttctttataatagattctaaaaagtaagactgttagcatccaataacaaagtggtcacaatagcttgtgtatatgtcaactatgaacaatagtccaattcaacagggcccttcccatccttgtacagtactattgtggttattttattttttatttgtacataattatttattattatatgatacatgtccagagtatctccatgtttaaatttttagttatttgctcatgagtaaggaaagttgaacatttttagacaggcttactgactataaatccttctttttgtaaagttttattcatgtactatatccatttttctattgggatagttctaaaaattatttataagaaagaactcttcttctctcttatcttgggggcattttaaatattggttttataagagactcacctggtatattcccaatgccaagcctgtacgaggtacttaataaatgatccttcagttttagatctatctgaaaacattaatttaaaattatggaattagacttcagagtgctgggttttttaaaagtagaaattacatctacttctgtgttgtaaaaactatgtattaaagttatatcaaataggaagagtacattttgcagggaaattctattaaattgcatctcctagagaagtgatttaaattaaattttcctgataaagtttttattcacatataatccttcacagggttcatttttccaggggttttcaattggcatttggctttttcagattagatagacagatggtaggtagacagatgatagatagatagatagatagatagatagatagatagatagacagacagatagatagatagataaatagacagatagacagacagacaacagatagatagatttttgttcccacagtcttttagcagggactatcttcgctgcagcccaggtcacttaaatctacatgctacttcctggatagcgcttctgagcctctgggattcccaggtcagtgacaccagggtcaaggacatggctggagtgagtttgggagtctgctctgctctcattacctgcctgcacatgggaggtgcaggccacagtgcagacctccaggcagcttcagcagcagctcttctcatctggagcagccctccttctttctttcctttggtgataaattgtatttggtgttagaaagtatatcttgtgctgaattctctagctgatagatttctgaaaattaattggcaccgaattttttttctaagaaacataaatttgtttggaaagtcagatcgacctgtcatttaaaacatgccttctatcgagcatcgactgtgggtcatccacttcacatgcttctacctctattccgaccactaatttgtaaggtaggtatcattatcccagtagactagatgagaaaatggggggtgtctcagtcaattcaggatgctataatgaactgccacggacagatggtctattaacaacataaatttatttctcacagtgccaggcactataagtccaaaaccagggtgctagtgtagctgaggtgtcttgaggacacccttccaggttgcagacggccatcttctcattgtaacctcacatggcagaaagcagagagagaaagcaagctgtcctcttttttaaaaagcactaatcccattcatgaggaccccacccccatgcctcccaataccattacactaggggctaggatttcaacctatgaatttagggggtacacaaatattcagtccatgacaaggagttggtgtggatgcatacattgttcaaggtcaccgagttggcagtagcagagctgaggataaaatccaaatttccccagtttcagagtctgtgttcttgacactaaagaacactgtcaatttgtggacagctcacgggcagaaattgtgcattactcatctgtatatctgtagcatttaatatgacacttggtacatagtagatgcttagtaagtctgtgttgaacagatgagtaagtgagtgagccagttaaactattcccagtgaaaagccagcgctgagctagactctgtcttgctattttgtgacaaatgatactccggagagagggaggaatgaggtcaaataagagtgaggagcagtggagtcacagttcctgctgaggactggggtgatctgtctgagagctgcctgccctcccttgcccatgagcagggaagatggcagagaccccattaagtgtcactaggattggagcagggattgaaacctctgcctttcccattttccctccctggagccctcccttcctttgcactgtgaactgttttctgctccatttcctctccaagccctcagatcaccctcagagctctctgttatcttccacatcatcctagctggaataaaatataactgtgtctgaaaagtacagaaatcaaagctccccttggggattttctttctgtatcacctgtcgaatggaaaaccggtgtgtccttgaaaagatatgtatttcaggccgcaggggtgctaatttgcaaggcccattactcaaataaaacattaaaagactcttcgataagccagtgctctcggcctgtttccactctggcaccaacataaccaactataggttttctgtcaagcttcagagcccaaagtcaagatttatcaatgatattttgactttaacttctacactttcattctgatgcggcattgcgtgctctgccatagctccccagcttcttgcaggttcctcactccgtccttgaattactgtagaagaagatgtgcttttgaagcatcttctggggttttaagtgtgaactttctactctgtgccgcacatattatctccatgagattgaaaacacatatttacaggccgaccacctttcagactgatgtggtatccagtggcattacagtatgtccaatactatggatagacttgtattgctttttattcagatttttaaaaattccaaatgtttttatttgacatgtcttaacatcttaaggaaaggaagtaggcagaaagaggagtcttcagtgacagtaccagctagagaggcagagagtattttgctggatattctttcagtcttgttttgcatttttatagggtctacattatactgtatttattctttcacactgtaacttaaatattcaagtgcaatttaaaattttcataaacaatttcaaatttttatgtaataatatcctgtcctgggaatataacataattagcccatcctctattactgtttacttaggttgtttttattgcaatgaataacactttaatgataatttttgtctattacacctttgcaagggaaataggaaaggggatcattttcataggagacctttcctggtgtggaaataccatgtcaaccgtcatgaatgtttcagactctcaatagctactgacaggcagcttcctgcaggtggagaacgtacccaaaatggcacctggataactctttttcctggctgatgttcatgttcataactcatgggcttagctgttgaccctgaatgcaaaagaaatggaatggaaaccagatcttgggccaactccagatttctggccgaatccattttaggtatgagggaggagaactgaatacatcaatgaacatatctttgttttgggataggagacttaaggtttaggataggaaatttaaaacttaggtttgaagttttctataagatcctttttttatcattgtaaaataggaaatgaatgctgtacttgaggtcacaggaaagtggcttctatttataatgacagaatgttcatttttgtaaaatttatagagtttcttactgtatactggttaagatattcaccttattgataaacagaatgattccttaccaagcccttcctggaaatcaggaaaggtaattggaatttacggcagttaccatgaactgttgcacctgtaggattagaggccattatcctggaatcttggatggattaattaatgaatcggcaaataaagcacgtgatgaattacgaagcgtcgtgtcattataatttcatgataaagtgtcttgttctggatgacattacattttgagattgaaataataactggctccctcaaaattttaaaggagctcccaagctctttcagatggaagagaggaaacaaaggggatagggatctatgagggggaaaaagcaggcgcctgtgttggggtgtggaaagcgccctcggagcccaccctggctagcagaggtcaactttgtgtaaacgcagcccactgctacagaggcctgagcatcgcctgctccagtgatgaagagcgatgaggcttaagccgacgtgggctagcaaaagttttaaatgtactttataattattttatgacctttctttctttgtaaactgcatgtcatttcccctctccttccctgaccaccaggctgccccgtgccagagctctgcctcaaaactggaaaccttgccagaagcgagagctgaaattgctttttggtgggtccgatttcatgctgagtgggaagcggcagctcagagatgaattggaaggccacgcttgtcagcgaatgaaacgtgatgaacctcagagttttattgacacgcggcgcggagctggcaatacagccggcactgcgtcttcttaatcccatgttcttggggtgggagtttgacccagtactttctgttagaaatgatacatatttattagactgtacggctaaaaagaaagaaacagtgtgcccggtgtcagacactatcgcaaccaaacctttcttttattaaaataaatacagacaattccaccgtgacagctcttccaccgagggggagccttattaagtggcgaccttcattctctccacagagacgggcaagctcgcatcagaccacttgtgggggaggaggatgtgggggagggtgggggcacctgtggagcattttatgggttttgagaaaaccaggctgaagtcctgagtagcctgcagttccgctaattacattcatcttctcattcgcctctaccaaatcaattgccgacaacatccaatctcattttctgcagtacatttctgtgagatatagctgtactaccaaccccttcctcctctctgggaatggcttcctgccaccaccctatgggacaggggctttagagggtgagggaatatgacaggtagacactttacaaacaatagaagctttccaggttctttcatgcaggctctgccaattgtgagagccaggggaatcgtatgaaaatgaggcaaactgttgtttctatttagttgaatatttgctccttaagttaatccttgtgtataccattattgcacgcgtgttgtattattttaagaaagaattacattggaaggaatagggaagagaagggaggatctctgtgcttgtgtacacacatatagcatatgtaaggtacacacatacacatatatacatatgcaccatatatgtgtgtgtacactgtatttccatatgtataccacacacatgtatatgtacacacacatactaaaatatcatacacacacatatacatacatacacactcacacgcaatggttctatgtggtttgataattcacagtgaatgctacctcaaaagacctcactgacaactgctagctatgttgtcctggaaaagacactaatattcgcccagcctaagtttcctcaaaggtaagtggacataaaataactagttcaaggggcaagtgtgagaatcaaaatcacgcaactcatgttaaatttgagtcaagttctggaaaacgttccaatccttaaacacaggattcaatccctgtgatatattttggacagttctatctgttctttaactgcgcttgcctgcatttgccctattgaatgtcattcttttgggttatttccattttttccatttgccaagatcattttagtcttcacatcagttcatcactgatattaattgagtgtcctcgcttgcggagaaccatatgaaggttcatcaagagacaaaagcagtaagagaagggcttacttttaaaatatccctgtcattaggctactcctctgatgttcctttgttttacccacattaagttcagatggcatttggggctttcgctgtcctcctaagcaggtctcgttcacccaccacgtctctgtcactggcgttggtctcctgcattcagcctggagcttttgactcaggcccttggttcttcttaaactttcctcctccacagcatgcaaagtccatgtttcactgtgtgttccctatgaaacctctccagaccccttaccctctctcatctctcctttcttgattcttcactttttttcctttttctttctttctttcttttttgagttggagtctgtctctgtcatccaggctggagtgcaatggtgcaatctcagctcaccgcaacctccacctcccatgttcaagcaattttcctacctcagcctcctgagtagctggaactacaggcacacaccataacacctggctaatttttttttttttttttgtattttttagtagatacatgttggccaagctggtctcaaagtcctggcctcaaatgatccacctgccttggcctcccaaagtgctgggattacaggcatgagccactgtgcccagccttcacttacttttaaagtcaatatgaaagctcaccatttgacaactaataggcaattgttcaactaattgttttcatctttctaaccaaatcatgagcaactttgggcacagtcatgtcttacatatcatcgtgtctcctttataatggatgccactatgcttactgtagtataggtactttacttattgattatttgagagatgggatgactccaacttttaagaagcttgtatcccaaaaaataccataaaccctaaagtagacatactatgctattttatattctatcatagatttttttttaactgagaaaaaaactgaattcttcctaatagacaactgtttctcaccctttgatttacgtcagattctagtccacttaaatttgctctacgtgaaatacatgttcagctgaaatatttgtggcccaggtctttgcctttttcagaagctccacatatgacgccagcgtacaccagagttggagaaccactacgatgtacttgtgtacttagattataaatggggaatatttattagattaccaactgtattacagatattttgtaagcactaaacatttgtttctttactgagctaatattaaatgtatctatgtatcccatgaaagtcaacttttgtttaaaatgacagtgctagaggcaagaggcactgaccaatgcttaaattagggggtaaaaatcaaagagaagcaggatattcgcacggtcttagcgaatcccctctgacgcgtatcaatcattgtgttggttttaacaaatcataaagccttggtgcccctctctcctggaggtggagcttaatctccctccctttgagtgcgggctgtagttagtggctatcatctcatgaatagagcatggaaagggcaaaactgtaactttacggtggaggattctggtggacaacaccttaaccaagtgatccgaaaccaggggggcatgctacagaatacctggtcactcctcttcaaagtcaaagtcatgaaggactaggaaagtccaagacactactacagattggaggagatttaggaaaaaggacaactaaatgcactgtgagatggtggatggagtcctggaaatcagtggaaaaactaaggaaatctaaataatgaagtttgcagtttagctaataatattgcaccagtgttcatatcttagttttgattattgtaccatggtttttaaagatgttaagtgaaagctatccaggagcaccctgtattatcgttgcaactcttctataaatctaaaatatttcaaaataaaaagttgggcatttttttaagaacaagaaaaaaatgcctgcttgaaagactgcacttttatcacaaaccacgcagtatgctgacatgtttccattaggcaagtgaaaggtgttccacaaatgtaggtggaggcaccgggttatctgctatgcattattgatgaatatcaccacaggaggttagagcacagcttgtcagaaaattccagagaagagaaatgacaactggtgaaattccctttaagtttattaaatacctgcctttcttcttttaaagaaagtgaaactccgtgacccatgagactaaaaataaaaaacttgagacaagggactgagggatggccattccatttaaatatgctcagtatgaaatgagcattctttaacaagaaatcattttgttaaagtgctaagcctttttcattatcgtttaatatctggtgacactggtagccataatgtatgtgtaaagaaaagattttattgtttgtgtctgatttttagagctatctgcaactgctttattctgattcactgagaaaatttcttagcttcactcccttctccaattaatgaactttcagtgtttctcaaggagcaaagatcatattaatctctctggttctttctatcagagtctgagtaaatcacttatactctaatgacaccaatagggtaagaaggatccagcggcgtttgacctgtgttacctacttggtctgattttcagttcttttgttaatatagaagccctttgattatagctgagtataaagtaataataaggattgttcttccatcccaaattgcatcctaactagaaagatctccacatatggaagtgttattgacatttgagagtttctttccattattcttgacacttctgtgcaaatagggtactcccttacatttgggggattacaaagagaagaaagaaagtgtatgtatgttgggaaaaaaagaaaatgttaattcctctaggcaaactcattagccctgtgattgtgaggattgtaggttatagagttatagttacataactgtacaatagaaagacctagagttttacagtctatccattcagcataggaatcattttctagtacttcttacacaaatactcattcagcactcactttaaataatcaccacggcagaagcacactataaataatattacttcaaaacatgaggcaaattccaacatgacacaactcaacagttgaattttggtgaaatataaatttgtagtttttatcattctgaaaattctacctattgattttactcatttcctctaagtaattcttcttttgcttttatgtgacacactctttttccatttgagagaactgtcatatatgacccaaatgaactgttttcaggctcaatggttataattttttcatgatttcttctataatatgtttactgtaaatatgcttgttcattgatattactcttaaagagtgctacccagaactgaacacaatctgagtcttcatcagttactgggcaatatgtttgtacatatccaagttgaaagatgcacagacactcagagaatatgtaagtgaaatacccataaggcctgctagtgatggctgtaatagggtagtttatcttattttgtgaactaattctacatgttggttaaaacaatgcccctttgaaccatttctcagccatgtgcctggataatgtaataatgtgtctatactagaagtcctcatctgtatgccctatttttgttctcattgtcagtgggcagatgtcatttgctatattctcatataactgaaatatgttccataggatcctggaccaaaagtgcctagcagagtgctggcacatactaggtattccataaccattagctgctttctttttctttaatgtttctgcttagagcaataatatcatttactcctggatctcctgtggtctgctggagctgatgaaaggctggagcatatgtgtttgttgccgtctcatcctggcattctattgggccttggctctgaagctcactgatacagttccgtatattgctctgcctaacttctctctcatacagtgcatcatctattttattagctctgtcaactttccaaagccctttcttcctcaaaacccccttgatccttttacctgtggaaacagtatctgactattttatcatctggctatttcaattaaattacattttaaaaaagcatacagtaaggttaaaaatgatcactatatcactccaactttcttccatccccagaaggttaattgaaaggcggccatcttggcgacgtttagacaaatgaggataattatgtgttctccagctctttgagaggttaattgcttagatgtacgaagccttgaagaacaaagaaggaataaatcagaaacaggactatcatctgataatgtaatttggtatattcatgtacaactcaaacaaataaacccctaattagatgaactcattcagttatgtgggcacactaccagtttaccagggtcagacacctcaaattgacttacttcattcagtggcctctgagagggtgggggagtgctaacctatgcagaggtaaaataggggctcttaggggcgtggtgtagtagggggttagaggagaggctcgcataatggaattttactacattgggtaaactcatctaagtgggtttagaccttttacctcttaatcagagggttgacttctgcacttctcctcaaacacatcttttcttcaggcaacatcatttcaacatctaggaagaaggcaaggaagtagcattaaaaaatctctacaagaagcagggaagtgcagttgtgcctggtagggggaatcagaactgagagtcgtggaaccctgtattcttatcctctgctagtttttcaccagctttgttggggtggcagaaagtaacttcttcagaaaaatatgagagagagaaatgatctgagtccttgtctacacaattgatccacttttttggcccttttaattgcatatagtaatttagttttaggtccctgtaaacacaagcacttggagtctggataggcatcgtagtgattgactctagccaagtatctgcaatgcattcagctttgctcccccttgtattaggtcgttcctgcattctataaataaatacatgatggctggtcacggtagctcatgcctgtaatcccagcactttgggaggccgaggtgtgtggatcatgaggtcaggagtttgagaccagcctggccaacatggtgaaaccccgtctttactaaagatacaaaaattagctgggcgtggtggtgcatgcctgtaatcccagctactcaggaggctaagacaggagaatcacttgaacccgggaggtggaggttgcagtgggccgagattgtgccactgcactccatcctgggtgacagagtgagactgtctcgaaaaagaaaagaaatacccgagactgggtactttattagaaaaaagatttaataggttcacagttctgcaggctttagaagaagtacagcatgaacatctgcttctaggggtgcctctggaaacttacaaccgtgatgaaaggtcaagtgggagcttgcatgtcacacggcaaaagcaggagcaagggcggggggaattgccgtacaatttttatttttactttttattttttttgagaccaggtctggctctgttgctcaggctggtgtgcagtggcaaatctgggctcactgcaccctctgcctcctgggctcaagagatccttccacctcagccaccttagtagctgggactacaggcacatgacaccacacccagctgaatttgttattttttttgtagtcatggggttttgccatgttgcccagactggtcttgaactcctgagctcaagtgatctgcctgcctcagcctcccaaagtgcccagatgacaggcatgaaccacagtgcccagccagccgcacacttttaaacgaccagaactcccgagaactcactcaccatcacaagaacagcaccaaggggatggggctgaaacatccgtgagaaatccactcccatgatccaatcagctgccagcaggccccacctccaacactggggattacatttcaatagatatttgggtggggacacatatccaaactatatcaccccttttaatcaaagtactacctgcaccaagtaaaataaataaatacacactcgctggttctgtatgattaactttcagccagatctgtttactcaacatttacaaaatggaactcagcactgagccagccttgtttgcatacttcactcttccatctcccaacctccattggttaaacattaacttccactgatgttaaccttctgttttgtaaccatgttttactttattatttagtctctaagtcaattataaaggcttaaagccaataaaaagcatttacattacagctttgtaaatggtattttctgtagaatgactatttctcaatggcttagggtgacagtttcttgaatacttgaattaaaaacagtcttaccatctagatgatatgaattgtttttcctactgttcatccattgctcaaacttattctacatttcactttgctccatattttgaccttacttttgtttattttagagtttctaaacaaatttcttttttcttgctgagaaactaaatgtatacattttcatataactgtaatatctttcatttatttacctattccattccaatgctgaaattaatttattcccctcaaaggcattttttgggagtgcccactggcttctagttctcacctaaactacttgctttctagacctgccttactgctactggctttaaacttctttacaaactggtttcatcccataatttcttttatccaatatcatcctctttgttttcactcttatttaaatgtaggtagaccttctttgttttaaccctaatttttctttggtacattctcaggtaacttcttcagaaaaaatatgagagagagaaatgttctgaatccttgcttgcccatttgatacttttttgtttttggcccttttaattgcatatagtaatttagttttaggttcctgtagacacaagcactaaactggctcctgtggactcaggctctaggttttctccaggactacactagtccatgtggcttcaaactccaacagacacaggacacaggcctttccaagtagactgcaaaaaaaccaaccaaacaaaaaactcaggtcccaggcctactgctgcaaatccaggttccaagtcatccaccatggtctcagccaccaggtctacttccgtggaccccagtaccaagtcaccttcatagaatcagaacaaggcccatccttgcaaatccagatgccaggcctgcctcagcaccaggctagattcatggactcaggctgaggcctgccctaacaccaggacagcccctgaagacccaggctttaggcccacccctgtggacccagatttcaggcctactcacatggacccaagttccagtcctgccctcagtggacacaggctccaggtatgctctctgcagaccaggtgccaggtcagtctctttagatcagtctctctaggcctgcttgctcactgacatatgcaccggatcattccacccaagaactctaacagcaagcctactggtagaccctaccaaccagcccaccagaatctctggacagactgagtgggaaatgacttccctggcaaagacagtctatacagaccggaagagatgtgtacttcttgtacaggcaacaaggattgcaaatatcagggaagcatggtgccaccaaaggcacaaaataaagtaccagtatagtcatacactggacagcaacattttggtcaatcatggcccatatatgcaaaggtggtcccacaagattataataccatatttttactgtacctttttaatgtttagatatatttagatacatgaatacttacccttgtgttacaattgcctacagtatacaaaataacaacatgcctatagcctaggagcaatagactatataccatatagcttagttgtatagtaggctatactacctaggcttgtgtgagtatactctataatgtttgcacaacaaaatcacctaacaacacacttctcaggacatatctttgttgtcaagcaatgcaggagtgtaacctagcctaatgaaatggaaatataggaactgcctgaaaaaatttaaaataattgtctttaaagagctcagttatctagaagacaaaacagatagagaaccaaacaaaattaggaaaacactacatgaacaaaattacaagtttaacaaaaagatgagagccattaaagaaagaaccaaacagaaatcctgcttctgtggaagacaatgactgaaatgaagaatttcatataaagcattgacagtagactcaatcaagcagaagaaataatcagcaagatcaaagtcatgtcatttgaagtagaggaacaaaaagaaaaaaaaagagtgaaaaagcctacgggacttatgggacaccatcgagtgagccaatatgtagcattataggtgttccagaaggagcaaagaaagagaaaggggaaataaacttgcttaagggaaaaatgacaaaaaacttcccaaatctggagaggaaaatgaatatccatatccatgaagatgaaagaactccaaatagactaaacataaaagatcttcactttgacacattataatcaaattctcaaaagtcaaagacaaagaaagaacgttaaatgcagcaagagaaaagtgactggttacatacaatggaaaccctcccccaactcccataaaactatcagcagatttctaagcagatttgcagccaggaaagaatggggtgatatagtcaaagtgctgggggaaagaagcgttaaacaagaatattataccagaaaaattgtctttcagaaatgaaggagattttcctagacaaacaaaaaactgagggagttcatcaccactagacctgccttacaataaatgccaaatggagtttttcaagttggaatgagagaacactaacttacagcaagaaaatatgtgcaatgtaaaagtcactctaaaggtaagaacatattcaaattcaggatactctaatacagaagagtggtgtgtaaataacttttaactctagtataatagttcagagacaagattattaaaaataattatagccataataatttcctgatgaacacaaactataaaatacgtaaattgtgatatcaacacaaaatgtagggaagaagttaaagtgtagaatttcgtatgtggttgaaattaagatttatcagcttaaagtagacggttataactacaagatgttttgatgtaagccctatgctaatcacaaaaacacctatagtagatacacaaaagataaaaaaaaaaggaaagcacacgcccaccaccaccacacacacacacacacacacacacacacacacaatcatcaaattgcaaagaaaggcagcaagggaggaagaaaggaaaaaagaaaccacaaagtagttggaaaacaacaaaatgacaccagaaaattatgcattataaataagtacattaaatttaaatggattaaattctccaatcaaaagacatagagtggctgagagcataaacacaaaaaactggtccaactatttgctgtcaacaaggacctcactttagattaaagacaaacataggctgaaagtgaaaggataggcaaagatattttgtataaatgggaatcaaaaggaagcaggtgtggctatactttaaccaacagaaatagactttaagtaaaagcctgtcataagagacaaaaatggtcattgatatggtttggctgtgcctctacactgaaatctcaccttgaattgcaataagtcccatgtgtcaagggtggggccaggcagagataattgaatcatggggtcaatttcccccatactgtgaataagtctcatgagatctgatggttttataaaccagagttctcctgcactagctctcttgcctgccaacatgtaagatgtgcctttgcttctcctttgtcttccaccatgattgtaaggcttccccagctatgctgaactatgagtccattaaacctctttcctttatacattacccagtcttgggtatgtctttattagcagtgtgagaacagactaatacaaaaatggtcactatataatgacaataaagagttcagttcatcaagaagatacaacaattgtaaatatataggcactcaatacaggggaacctaaatatgtaaagcaaacattagcagaatgaaagagcaaaatagataacaatacagtaatagtaagggacttgaatacattattttcaacgatagatagatcatccagacagaatttcaataaggaaatatgcactttaacaacgctgtaagccaaaatagacctaacagacacatacagaacatttcatccatcagcagcagaacgcacactgtttccaagcacacatggaatattccccacgacagattatatgttcaaccacaaaataagtcttaacaaatttaagaagtttaaaattctatcaagttcctcttctgaccacaatggtgcaaaactagagattgataataggaggaatattggaaaactcacaaatatttggaaattttacaacacattactgaaccacgaggggtcaaagaagaaatcaaaaggatattttttaaaaatctgagacaaacaaaaatgaaagcacaacataccaaaacttaagggatgcagcaaaaacagcttcaagtggagatattatagcaacaaacacctatattagagggaaaaaaatctcagataagcacctagctttatgcctataggtactagaaaaaaagatcaaacaaagcccaaaattagcagaagaaagtaattaatgaagattagaacagaaataaataaagactgaaaacaataaacaatttaaaacagagttgttttttaaaaggacaaacaagagtgactaacctttagctagactaagaaaaaaaagagaagactgaaataaaaaaatttataaatcaaagagtacacaatacagtttacagaaacacaaaagatcataagagactactatgaacaattatacaccaatgaactgaataaccaagaacaatttatcaagaatgaatcatgaagaaatagaaaatctgaataggccaattacaaggattgaatcagaaattaaataactcccaaaaaagaaaagcccaagatctgatggcttcactggtgaattatactaaatgtctaaataattaatgtcaatcctcaaatttttcttaaagaatttaaaagaagggaataattccaaactagttttatgagaccagtattccccagataccaaagccagacaaggatactacaagaaaagaaaaagataggccaatattcctgataaatataaatgcataaatccttaacaaaatattagccaactgaatttatagcacattaaaagagtcacacatcataacttaagtgggatttattcctaacatgcaaggatggttcaacatatgcaaattaataattatggtgcactacgttaacagaatgaaagatagaagttatatgatcgtatcaacagattcagaaaaaaggtgacaaaattcaacattgttttatgataaaccctctgagcaagttatttatagaacgaatgtgcctcaatattataaagtccatatatgacaagtccacagctaacatcatattctatagtaaagagatgaaagcttatcttctaagaagaggaacaagacaaagatgtccatctatctcttttatctaacaaagtgttgaaagtcttagcctgaacaattagacaagaaaagaaataaaagagtttcaaattggaaaagaagaagtaaaattgtctccgtttgcagatgacataatcttaaatatagaaaatgccaaagcctccaccaacaaactgctagaactaataaattcagtaaagttactggataaaaaatcaacatacaaatatcagttgcattttcatacactaataagaacctatcaaaaagaagttgaaacaacagtcccatttacaatagcattaaaaaaaccttaggaataaatttaaccaggaggtaaaagacttgtacactgaaaactataagagattgatgaaaaaaattaaagatgacaagaataaatggaaagatatctcatgttcctgaattggaaaaattaatattgttaaaatgtctgcaatacccaaagcgatttacaatttcaatgcaatctttatcaaaatatcaatggcattttttttcagagaaatataaagaacaattctaaaatttattgaaaaaattggatattcacatgcagaagaatgaacttggacccaactatatatatatgaaaatcatctaaaaattgattaaagacttaaacataagacctgaaactgtaaaactacaagaagaaaaccatcaaaaagattcttgaaattggtctgggcaatgatttttggatatgatcccaaaagcataggcaataaaaacaaaaatgaacaaatggaattgcatcaaactaaaagacatatacagcaaataaaataatcaacagagtgaagagacagcctaaagaatgggagaaaatatttgcaaaccatatatctgagaaggcattaatatccgaaatatatacaaactcaacttaatgacaagaaaataaaaccttattaaaaatgggcaaaggacctgaacggacatttttcaaaataagacatacagttgaccaacaggtatatttaaaaaaactcaacatcactaatcatcagggaaatacaaatcaaaaccacaaacatacataatctcacagctattagaatgccagttgtcagcatgacaaaagatcagtgttggagaggatgcggagaaaagggaaccctggtacactgttggtggaaatttgaattggtatagccattgtggaaacagtatggaagttcctcaaaaaattaaaaagagaactatcaaatgatccagcaatcttacttctgggtatatgccccctcaaaaattgaaatcagggctgggtgtggtagcccacatctgtaatcccagcacttcgggaggctgatacagaaggattacttgggcccagggcaacaagaagagatcccatctctacaataaataaataaataaataaataaataaataaataaataaataaataaatagaaaataaaataaaataaattaatataaaataaaatacaaaattaacctggtgtggtaatgcatgcctgtggtcccctgctattcaaggaggctaaggtgagaggattacttgagccccggaggacaaggctgcagtaagccatgattacaccactgcactccagcctgggcaacagagagagaggccttgtctcaagaaaaaaacaaaatgaaatcagtattgtgaagagatatatgcactgccatgttcactgcaacactgtgcacaatagccaagatatggaatccacataagcatccactgatgggtgaatggataaagaacgtgttctatataaaaatatacaatggaatattattcagccataataaaggctgtgacaacatggatggacctggagggcattattccaagtaaaacaaagcgggcataggaagacaaaattttgcatgatctcacttatatgtagaatctaaaaaaatttaaattcacagaaagagagtgtcgaatggtgattgtcagggactggaggaggagggaagcagggagatgtttgtcaaatgatacaacattttggttatgcaggatgactaagttctgtaaacctaatgtacagcactgtgactgtagttaataatagtgtatcgcatacttgaaatttgctagaagatctcttaaatgctcttcccatatccagaaaaaaagaaggtaattatgtgaggtgatggatatgttaattaacatgactgtggcaatcatttcataatgtatacatatatcaaaacatcatgttgtgcatcttaaatatgcacaatttttctttgtcaattatacctcaatgaaacggggaaattttcattttaaaatagttttgccacattttgcttttttcatccatgattcaaaaataagacaactgttgtcagtcctgatgactaatcctttatataggacctatacatatgagcatggaaatatatttatttttgtttagaagtgttcacgatgttgctttattcttagtgtttggaaatttcacagtgatgtatctgtatatgaatcatttttcattaatcctgtttggtattcagcctataatttgttggtaacattttcttctatttcctaagtaatttcttctctactttctccattctctaattctgcaggttttatgggtcagcgttggactttttgggttgactacatcttcatgtgtgtctgtgtgtgtgtgtgtctctgcataagttttgttgtatgtgatacaatagttcctatctgatacgagcagtgcttcctcacacatactttccatcatggtcttcttgctccagttctgagagatttcctctgctttactgggtagcctattaattttattttaatacaacaatattatttttaattccatgggcttgttatttttccctgacaattacttctacatagtatctatttatttatcttattggtatagtatcatcttaaatctctaagaataccaattagaggtgcttaaaaaatactttctcctgttccctgtttcttctgagaccagttttctttgtttatcttagccttctaaaaaatttactagttttattttgtgattgtcatatatatttgtgaggcactggaataggatttcatcatagctagggtgggctttctgtgatgttgtaaatgtagatccttcttcctactgagtttctcccataaatgctaaagcatctaggtgcttatgtgattaagctcatttatgggcaggtggcacatttcttaacacagacatggaaataaactttagggtcgggcattctcaaatgctaaactggggcaaattccttggcagcttatttatttatttatttatttttaaaagaaaccatttgttctatttgcctgggttaatagtgggctgtctgtgttttgtgtgcaaagagatgtgcaggaagggctggaggaagaactgacttgtgggtgcagttgccatttcatcctctgttgttggccccactgctcatttctgccctccatacctctgccttcaattccaagccactccgaattctgtctgacaagttcacacttgtgctagagcactctcctgaggagtggcttccttgtgtcttgttcatctttctccatacttctaggattttcttgaaagtccttgtctgctgatcctccctcacctgtgctctttgatgttatgtgatgattccttttattttcccctttactgtcattgtagtgggtgtcaggaagaagaaatcgccaatagatgtgtctagtgagatctccaagttcaggtcctgctggctgccctcatcttttgtgtcattacataaatatacagtgcacacaggtctactaagcttgtttttctatgtatcaactaagcctagcacagactagtgaagttattcagcctggtcatgaaacccctcagcatctgtctcctttgaagatggattgttaagctccttaatgtgttatataagctctcatgctcagcccttcacctccttgcccagggctcactttgaattgcacattgccataatactgctcctgcctcccgcacttccatggcttccattgtgcttttatttggcctagaatacaccataccatcactgcctttccccctagactaacagtacccatcattcaaggattatgcagcatatcgtatttcaggaacatttacttgactccaactcccaaaatggacaggcaaagttctaaggggccgtgcttccaatgaacagtctctcactctctctccgtatttttcataacctttaccacatatccttttaattaatttgcatatgtgcctataatccccctaagtgtctcaagggcacggaagcattgcatcagctgaggttgtatttggctgcaagtgataaaacgcacatgctgtgtttgaacccagtaggagtccgttcttctcaacaaagatctttgaaggtatgcatttcagagctaggcaataattttttatgccattaatgtcgcaggtatcatctttcctttctctctatcatacgtagtctatagtttctaagtcttgccatttcctggtctcaaaatgcttgttccttcctttgtcaccacagaccagaacaaaactaaggaaggaaggggagaattgcagcataggtatctgtaaactccaaagtcctgggatccttgggcagatacccatcttcttcttattggacagaattgaggcacgtggtcacctctggctgcaagaaagtctagaaagatgtgttttatctatgcagtcaccaccttcaacagctctgaggttctcttagaagaaagaaggggagcatgaagataggaagcaactggcagcatgtagcacaaagttgttgttcattttttatatcttctttactgtgcacaatagctggcacatagtaagcactcatcaaacatttatagagaaagacattgacttggccaggcacggtggctcacgcctataatcccagcactttgggaggccgagatgggcagatcacgaggtcaggaaatcaagagcatcctggccaacatggtgaaacctcacctctactaaaacacaaaaaattagccgggcgtggtggcacgcaccagtagtcccagctatttgggaggctgaggcaggggaatcgcttgaaccccggaggcggagattgcagtgagccaagatcgcgccactgcactccagcctgatgatagaggaagattccgtcttaaaaaaaaaaaaaaaaaaaaaaaaaaaaaaaaaaaaaagacattgatttcacagaacgaaactctttttctaggagaagaaagctctgaagagtttaaatgatttcaccaagattcatagctagatatggcagaactgtgagaggttttaggaagaacatgaaatcagagcctctctcagtcatcctgcagagagtgtggtttgtattctaatttctggaaccaatctggtataataaactagaaaaataggtcacgtgtttctttgtcatttgagtttaagattcttattactgggtcacataactcctattttcatactgaaaccaaatcactcagagactcgtgtccagatgtgtctggacctctccgtggtggcccttgattatttctagcccaataaaagagaaaggaatttcaatttctaaaggaaaatgaaaaccaattatagcaaaccttaacaagaaggaaaaggtggtggcctataccactccacttcttcaaatgggttatttgattttgcttaattgttggtaaaattttctcaaattggcaattataatctggagctgattgcttacccaggtaatttacagatttctcatttggcaagaatgcttcagaacacttaccatgaagtatggcttcatcatccttaagctgaattttccttttttaatatattcttcatttggagaatgttattacctttgcccacaggaagtttaggtgctaattctgttagctgcatgtttctgatgaaatcaaggggttgtttgtacaatttgtttgaaatcacttagggccccagtggaattgattaggtgtttcccaaagcaaataaaataatcaggctaaggtaggcattcatcaaagttagctgcaatgtattaacaataggtcatactttttggtcctgaaggggggttttatgaggtaacaactatgctgtctcctctgccttcaatcttagagcacagtcttccactcactccccttgtcagtctcgtctgaaatcaaagtttaattatccttatttgctcttgtactgtgcattaagatagagtttatccagtagtccagctgttttgaagataattagtagagaattcaacctgctctaaaataatccttctgggcaaagagccaggaactgaggacatattctccaatgataccaagttctcctttacttgtaagtcacacattttctatctcaagtcaaatactgtgcattgtactatgaagttgggagtttgaattgcaaagcatgatttccattcttaataagtgtctgctttaggaaaattgtgctatttccatttagaggaattgttaaagccagtgggaaaaggtggttcatgatcaatttcaatacaaggaccaatggacattttaatttttattttggcatgaacttgagtggtagggaacatctttgcacataaatgttggtgatgtttgctttgtttaattattattcagtaaacattcatggagcacctattataaccagacaccattctaaccacgtgggatgaaattgtgaacaggatttactagttcctgcctccggaagctcaacattttgaagggaaaatgtttctgtggtttattttctattgcagtgaaagcacctcccctgggtgatttattaattttccagcaagtgattgatttatcaattttccaccaaagtggcaagctggctttggatctaagactgaatatggagcaatatagtcaggttctctttaatacagcttactaatgtcatctgtcctctctgtttagtgctgtagcttagaggaaaactgccaagtcccaaaagatgcctgatcctatagatgcatgagctgcatggcaacgagtgttaattaccagcacctaattacagcactcattttatatggagtgaatttagtgctggacacaccaaccttctcccactttctttgtgaacaacagctcattttttttttttttcctgtagcatcaccaatgacaggaagagaagcaaaaggcaaacctgatcttcctattgaacttcaggttcttgaattttcaggtctgctaacattgcttacgataaatgatgcttttcttctgctgcttttgattgaagaacactagaaatcagtcggggagcaggtgctgcattgtgttagattaacgctgattgaattcttacacagccagctgattgaagcacgtgttctgcaagcttatgattctacaaacactaggttgcaaccaggagggtattttgccatatcaagtcccttaatcaacaccctcaaatctgtcgatactgtcaactggagcttagacttctaagtcccctctgtgaaatagtaccctaagctggtcacaagcataaaaatggatttctggaaaaagaagagacatggtttcaaatgctgtttccttctcatgctgagtagatgaacatttaaatcatgacaataatcagatgttcatcagacttggtaatgaaactggatggacataggcctttttgttctccatttaatagcatccaatttgctaacaggatgaaaaaatttgagttgttggcacagaattcttgaaactacccatgggagtacaccaggtgctgtcactggatggtccaggccaacactccacatgtagctgacactcaacatcttttatcctacattttaaaaatgcatgacatataagccctatgacactgcagaggctaccctactgggaaggaaatggagttagttggtaggagaaataacacagaagttgacacaattgcaaataaggacttggacaatcttgtgaaaaccaagagaccattatttttctgcaatggctttaacctagtcttcacctagttcagagagctgtcaggaggctcactagctgttttgaccgtgaatagccatgcaatgggaggtcaggaggtatcaacagtgagcaaaaatatcttcttgccattgaatgcatccattcactcacaattcacatagtcaaatgtttttcaagtatacattatctaatatataaagcaatcttaagaacaaaggagaaattatctgtggctccgtttccttatatttaagtggggtctatgttagcacctacttcatagggttgtcatggggctaaaatgactaatatgtgtagaacagcatcttccaccttctatgtgccttctatgcaagagcaagatcaatgttaggtcttattagtggtctgatgagagaatgagtcaacctgaaaggtttcgtaaagcctattttgcatgttttctttatacaattgcacttttctatatggaatctcttaatttcttatgatatttccttttaaactgaaagctgctttccacctaacacatacagaatagtccgaaatcctgctgggtaaggcttgaggtgagcaatgagttcctgcctctttcttaggctttattaaccccaatgctataatcttggtttctctccttttatgctgtaacccagaatctactgctatgcctgtgcaggcacacacgcatgagcacacacacgtacacactcaaacatcccatgtttgaatgaatgactgaatagatgtattcataaccagtggaaggaaaaaagaatggtttggtacgttaaccattccatttctcttcctctgtcttaagactggtactcagagagaaagaaatatgccagtcacttcatgcagtgaactctctcagctttcctttgacacactccagtagtgattttattatacaaataggcactcggagatgataatgcattgtggtcttcaaagtgtgctcaccataccagcagcataagcattatctaatcttgttagagatgtactttctaactctggccccacttcagctatactgattcaaaagctctagaatgaaacccagtaatcttgttttaataggtcttccagatgactcggatgcacgttaagtttaagaacctggcttggccaggcatggtgatgggctcctgtaaccccagctctttgtgagactgaggtgggaggaccacttgaacccaggagtttgaggccaacctgggcaacatagtaagacgctgccaaaaaagaaaagaaaaagacaaagaacctgatctaagtgaaatctaaacctatattttgattcatgttcttagccttgggccagtgtgatccagtactgtcacatagaaggtccacgaaacttgtttagaatgttgcttctgtttacatacataaagtaagtcattttctctcagcattagatatgagcactcccatagtttttttcctataaatgattacttatggtccaaggcaaattttaattctttgttaacttctttttaaagaaggtataaaggtatatttcatgtggcaaaatgcatctgccccattctttccattgatgtattttacaaagcttatttcatgagataaagatcctcttaaggttcagctacttggataagatctcacaggtaagtaaatggcagggctgagttggaatgccagtgttttgactccacagactctgttatcaaattctgtgcagtactgctcttcctgcctcatgacacctcgtctctaccttccagagatgttaaatatcaatttatgacattgagccatctcagtcaaaaatacagctaaacaaatgtttttctaagctatctgtgacacagtctacttttgaaccagtggataaggttgcaggcatttttcttttctaatacccttagctgggaatgggattggtgtggcttctagaatcacaattttgtcaatacacggagagagtctttgccctattcctcagaacaaaaccattactctttaccacaaaatttgaactgtcagtcatccaaacatttttgctctttataaacttgtcattttaaatcaatgagaaaacaaaggagggccttattccaagtgaggaaacctcaccacataatccagtgaaaatcccaatgtaacaatctaattgcccttcacaatttagatgacattattgaatgttttctttgtatattctgaaaacaagcctagaaatgtattaaaaataattatggagccctgcctcacagactgaaacagcattcccgggatttgttacatgtcacacgtaatcctcagggcaggcagctcaggggctcaaagagcacagtcagctcattttactaacaatttgtttctcaaatacacaaaaaggagcttttctattttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttttttagtagagacggggtttcaccttgttagccaggatggtctcgatctcctgacctcatgatccacccgcctcggcctcccaatctatttttatattttgtatctattagataatatgctctcttgctgaaaatgcagcctggttctacttaatgtaaggttatccagtaccaattccatcaaaaacagtgataccatcattatttccaggctgcattgaatatactatcattccttgaaaaaggttaaaaaagacaatttctaaattacagcctttaattggagaggtcttggcaaccaccacatccaatatcctggatttcagattggataactgaggcccaggaaagctctttgatttcccaaggtcacactcaatgtctcaagctagtgtcggtcaggactagattacgggtaccagtttagtgctcttgtttctcctcatgtttgtcatttactgccggttcaaagagcatgagtgatgaaaaatatgctcatccattcaacttctttttctttgcgaagaatatgttgtgttttgactacacaggggaatgtgggttttttgtttgtttttaagtttaattttcggcaagaatcataaaaaaaaaaaaccatgattcctaaacagaaaagccggaattattattaatgtacatgttttgttatccaaaaagggcttttgcaggaatcctagcaaatgtcccttctgctaaagaaataggtgatagaatcgtcatttcccggatagaagcagcaacatccagaatgattaagtgcctttgtgtgaatggcaaagcaagttatccctagattttttaagtctcctggagtgcattctatagtaaatcacagagagcccaatttgcaaagcaaattagtggaatatctgttttataccaaacatttagctctaaaaaagtctacccctctacttttcagtgagtatggaagcagttgcagaaagaaagaaagtaaagtgactgatgcaaattagactggagatattacaagaatcaaatcactttctaaatacttgttacttagtacttcaatttgggagttgattttgtgacaaacaggagagttgctttcagatggaaaatgctatgatatgacctcagatggtgaaattaagatggaagaagctcatttaaatacaagttctgcttttaattctctgagtatttgagggattaaaaaagaaaagaatataatagaaagatattttaaaaaataattttctatgctgaggaaaggctgtgttttaagttttgcagaagaagatcggatttatgttaaggatcttaaattgcaaatcaatgctacagcacttcttgctatacagattaaatatatatatatatatatatatatatatatatatatatatatatatatatatatatatatgtagcttaaggcagagcagtttatatgaactccatagattgagaaatagaagtccaagtcttgagcagagcattcaaatcaacagaatatatcaacatattcaaaacaacataatacggcaaaactgaccttaataggataaagctaaatcaagaaaaatttggtcccctggtgagtggaaaaattcctaaccgtaatacatatgagagagtaacacgatttcctgagggaattgtctttcttcctgttattattcagtgtttgtcaagtgcctacatttatagatcttatttaaaatagaactagttatagtctctgccaaatgaccctacaatattgtgtgacttcagctagctagaaatatctcagggggcagctgagtagcataaaaatatctctgatgtccagaaggggtgtctatcttccagcacagcagccagacattctgcttataggtctggttttctgtgccacggccttttctctttgatatccatcaagaaggagtgtttacactgaaaatggggtgtgagtgggacaaaaacactcctgggggatctgtgggtgatgtgtccagaatagggcattcgaaacatcaatgtgggagaatagaacacgtggaaaaacaaatataaagttttgacagtcctagaaacctagggtcaatggacagcttaaggaaccttctcaggacactggggaatgggaataggagatgctcctatagaagtgttttgagcagtaaagaaattggactaatgagaggtcattgatactttggttccagagaacccatgtgctggccataaactgaaactatttgcataagaggcacgatgttttggaaggactttacatgagaagaagggatttgaagagtagaaaagcatttcttcaattgaatcaatcagattccattatttgcaagttaatatacagtcagtttctgtagactgcagtgagttctccatcttccttggtagttcttgaggacaggacagatcagaccttcgtggatttagccaattatgactgagaaagcctagaagattattgttaaaactccattttccgaggcaaggcactgtggtttctgtcctcattttcatgttgttgtatttgggattgtcatgtcccccaaaggcaagttgcacagtctgagttagaattgatgatctgcacacatctgcttcggggaacttggggccagcacctgaaggacagcctgatgctgatcaactggaaatagatcagaaggtttggagagagatcacagatggactagaattaaggaatggacagctctataggtgaggcagacaatgcaatgacagcaggtgggagcaggcattaagtgaacatgcctcatgccccacaactcaaaataaatgccaccagaacaataatagaggcccaaaggacgttgttgttccttttgggatcccttgtattaaacccgaagttacacactgcagatgccattgaactgggggctaatttagtgatttacattgttgagaaaggattagtgaaacctcccatttcgatgacctgtttctaatttgcatctttaacgaggtgggattcaagccaggttctactcctttgtgtttacttctcaggaactgtgtttatttctgataattacaaataaatctttcttccttttctcaaactgactgaataaaagatggggggagtgtgttaactccatagcttgaataactatcaaaaaaagggagacataaaatccaattataactccttcaaacatgtaattactgtttccttcccaaagaggatgattgctacatttcattttaaaacatgtgtcttctcctttgtggttttttgcagcttgtctaagagaaacttgccccacaggaagtggtggctccagactgggatgtcgtgacccggtgtgtcatgaaaaatgatagcaccaaagaaaatgtaggctacagacttcaaaacttgataaagaagtgttctgattaatttccaaagaactcagggagccaaagcaaatctctcaacatttttaggtctcttgaagaagcaagggagaaatgtcatatgtattctgaattcaactaagactgacatcatacagacacactgaaaagctattccaatgaccacaaaaacggaaagggaaaatccagtgcttgtctattgcaatagactattggcatggagatgacagggcaagaaaaagcttgattaggagtactttttagagcaaatcaaatccaaagatagccatttaaaagttacattgacaatacataatttaatcaggtttaggcatcagtcctgatatcaaatttaaaataagctctacataaacacaatcattctgcaggtaatttagtatttaggtgaaggtggattaataaaagagcttttagtgggtacagaagagatgctgacttttaaatatctaatagctgtaccaatattgagcccaaactgttttttaaaatatagctttaagacaaataggaaattcaagtgaagaaaatcaacccagaagagacattgatcatcttacaacagtgaccgcaaagttatttatttgtctgtctgttggttggtttttgaacaaacgcatatagaaagcaaagctccacaagaacaaagatttttgtccatttttcactgctgattaattctttgtgtatagatgatattcagcacatcctgggcactctagaaatatttgttaagctaatgaatccattggttttataattataatatttattttcataacaggattaggaaccttttgtcctattgaggtagaaaaatatatattaaactccataaaagccaacaaaggaatttaatttagatttagtatctgtgtcctctgtggaaatggcttaatacgctaatgtgccaattaatatattctgctttatattagaatcatatgatgtaatatgaattaggggtgaagcatgagttttatagcaaaactagctctcccacttactatatttgctgggacacacgacctttctgaggctcaatttactaacctataaaatggaaataaagttgcctatctcaaagatgttgagagaattcatgcaaataatctgaatacagtgtctagcatatatatttataatagccactagtatagcaggagctaactttattattgttattggtattaagcattataaattaattaaggagaggtatgtcaagttctttagttttaatctctcagttcatcagcgattatcgtgtagcctagaactgctcatctttatttgcaaaagggattttttaacataaacaatattgtatttttggtgtgtaacaaatgtctgtgctaatactaaaagggtcaatacaagtataaagttggagacaaatattcagaaagggacatctcggggaggcaaaattatgacgtacctgttaatagtagctagaggtatagaatattaaaactgaaagggagctttgatatgatgcaatgcaatcccatcatttcacagagggcaaaactcactcagagccactttcccaaggtcccttgcccaaggtccctctgagacctgctttgtatgtacacaaggatagctgaacctgacccatgagtcagcatcagtatcactctgaatgacagcacattctgctttctaaagatggagtgagaagaattggaaatactgggctgtagtaataagcaaattgaatgcatgagttatggtttgcaaatgtcttttacaaacttctcattttattctcacagtctgagatggtgtcatcccaactttaaaaatgagaaaattgaggttcagagaagttatttaagttacgaaaagtcatacatttgataggtagcaggatttggtcttgatattaggttttgtgactctaaatcatctactttttccagtctgagcagcatatcaaccaggtttttccttaagaaagtagtgcacctgtcaacttttgcttttttattttttgagacagagtctcactctctcacccaggctggagtgcagtggcgcaaccatggctcaaacaatcctcctacctcagcctcgtaagtaactgggactacaggcatgcgccactatgcctgattaattttttaatttttatgtagcgacagagtctctctgtgttgctcaggctggtctccaactcttccagcctcaacttcccaaattattgggattacgggtgtgagccaccacactcggtcttgcttttatattttttacaagtattttaatactctattagagcataaagtaaataaaaattccttcaaccacttagatataagttgtgtgctaaactcataagaacatcaaaatctagaatgagaatgttataaatgagtttgaggcttaattcttctgactggccttgaatacattattttgcctctattacccagtttgaatggtgagaaacccttttgaagaaggcacctgctggtgacaagtgagagcgtgaaagaccttccacatgcaggggaatgacacctttgggtcacagtgtgagagagggtcacgcattgtgaagtctggtagaatagaaattagtatctatgtaacgggagaaagatcttgttgaggagagatcaacttttactcatggctgagatgggtcctttacacaggtctcggtcctccgttctctccctggttgctccattctctccctggttgctctctagaggagaggttaattgcctccttatcgcctctttattgccctgtgggcacaaactgctttgagtttgccataagcagaccttggttctaaacaggctttctcatgtgtgggtgcttaattaatgtcccaaagatgattgttctctcttaactcagattctattccttttagcaagggtttgaaagaggctggcccccttttagcatcttaacagttaaaaacaaagagaaggaaaagagtttttttaaaagatgatatgttataaaacataaatgagatagagaattttcttcatgcctccttccttcctctaagaaacataaattcttgtggtctttgctgccttttattagggattctgtcagcttaggttagaaacctactgaaacaggaaattttccctgacgccttcccaggcctcatgacgagggtgccttgcttaccagcccatagctctcaacctcttgtgggagagagagcactcaggtgagagggtgcaggagcgtgggtgagcgcttttgagtgctggcaggagcaaaactccgtgcagctatgcagcagcatctggggggatacctgagtcccctgaagccccagagggcacgtgttacagcgctcctttagctttgccagccacatcacagatggcttaattgttagacagctcagtggggcatcagtgtgactttttttttttttgagacggaatctctctctgtcgcccaggctggggtgcagtggcgcgatctcggctcactgcaagctccacctcccgggttcacgccattctcctgcctcagcctcctgagtagctgggaatacaggtgcccgccaccaccccagctaatttttttgtatttttagtagagacggggtttcaccgtgttagccaggatggtctcgatctcctgacctcgtgatctgcccacctcggcctcccaaagtgctgggattacaggtgtgagccaccacggctggctgcatcagtgtgatcttttgcacccacacccgagttcttgtccggcatcccggaggaatgaggttgcaggaacaaactgaagggtggtgaaagcggaggattttattgccgatgtgaaagaggctctcagtgggaaggggagctggagaggagatggagcaggaaggtcatcttcccccagagtccagttgttcctgactggactcctttctgaaaaaatgccatcaagctgtcccccatgaagccaagctgcttctctcccatgtcgaactgcagtctccgacatccagctgcttctcctcttctccccttctctgctctctgccagtcaagtcagtggattttatgggtacaggacagggggcagggcaggccagggatggttttggaaaaggcaacatttgagtgggaaaatggggatgtaaagttcttactgtgggcagcagttccaggcttgagggtggggcccttgccagggaccgcacccttttctgcctagaatttccctgcctcctctccctatcactatcagaaaatgagattttggagacaagtcctgcagtgtcaaaacatgagggacaaccatgtggcctcactctcctctggttgccttgtccttcaggcttaggaaggcaacccccgcctgccagccattcttggctggaggggttctgctagtttgggagattactcagcagcttcatggccctttaccatcaccaacaccacgctgcgcgatgcttgcctgagaaaagatgccatgggtttggagcgggagaaaactgactggggcatgagggcaacaggcgtcttctgctgctgaattcttcacatgcaggagcggcttgtcagtctcattaatgaaggcagcatgcaaccgccagagtgattcaagctagggcctggctaataggcccccagagaggacactgaccagtttctctgctcgaatataaagagcttatccacagtgttatctgtatcgttgacactaagtaaaataattccttggaaaacttcaaaattagcattaagaataaagaatcatcacaattacagctgaggtagcgtggccgcagccgccccagctccctcttccactcatcttcttacttgactgcgcctgcagccagggcctttttctcttgaaggttccgaacctgaaatttttattcttcagccctgaggaaagtgcatcagatctgtcttcacgtgggcaaagggaacaactgcctatgtggtaggatatgttttagcacttcttcaaggggtgggtttctctccaatctgggagagatttcctgccctttgtgttactcctttatacttggtgatgctgatgatgactcagagaagaccactactgaaatatacaggttacctgaggggatgtgagttgatgagagggcccatgataaagtgggtgttttatcccatgataaattggggttattaaagcagatgtccaaccctgaggcactgggtgaggggcaggtgcattgcacaatggcttgatcacggccactcagctccagtaataaagcagaatggttcacagcacctgaatttgccacagtgacatgggaaattgcactctgtagacctgagcacattctggaatacatgtgggttgataaagcatcttgcattcacaaaagaaaaaaaattgaagaataaattgagataaaaccttctctactcttgcatctactaaaaagtccttctttgagaatgcacatcacctaccactccacctgtctccaacaaacagttcctttggataaccatcaaatcacactcacacgtccataatcatagcattaattttgatcacctgaagaccaaatatatcttttaacatcctccttcatggattaggcacactcctccctttttgtaacagttttattgtgatataatttacatgccatacactttactcatttaaagtgtgcaccttgtttgtttttcgtatatttgcagagttgtacaactatctacacaatcagttttagaacaattccatcatcctccaggttaatcccatacctattaacagtcattccccatttcctgctcatctttccttcgcaatcttaggcaatcaagcaactattttctgtctttttagatttgcctgttctgaacagttcatatcaatggaatcatacaataggagatcttttgttgttgtcttatttcatttagtgtgttttcaaggttgatccacgttggagaatgtatcactactttattctttatatatggctgaatatatttcaccatgtggatatacccacattttattcatccattcatcagttaacatttgggctatttttcctttttgtctataatgaataatgctgttatgaacatttgtgtatacgtttttgtgtggacgtgtgttcatttctcctgtgtatgtatctaggaatagacttactgagtcatatagtatctcatgatcaacttctgagaaactgacacagttttccaccacagctgcctcgttttgcattcccacaagcagtccctgaggattcccatctcttcacatcctggccaacaattatttcattaatattttcttttttattgtcaaatattttaatatctgccttaatagaatttatttttagagcagttttaggttcacagtaaaattgagagaaatatacagagtccccacacatcccctgctctcccccagagcctccccatcatcaccacccccaccggagtgggccattgttacagctgaggaacctacaatgacacatcatcactggcagactgtgtagttcacaataaggttcactcttggttttgtacatttcatagttttagacaaatgtgtaatgagatagagccaccacgctagtattatacagagtagttcaactatcctgtaagccccattgctctgcctgttcacctctccctcgcccaacccctaatagccactgatggtttttctgtttccgtagtttttccttttctagaatgtcatgtagctggaatcatacaatatgtagccttttcaaattcatattttacttagtaatatgcatttaagttaccaacatgtctttttgtggctcatttctttttactactgaatagtattctgttgtctggatgtaacgcagtttatccactcacctactgaagaacctcttagttgcttcctaatttaggtagttatgaataaagttgcggtaaacatctgtgtgcaggtctttgcatggtcataaactttcaactcctttagaaaaatagtaaaaaggacatttgttggattataaggtaagagtacgtttaattttgtacaaaactgtcaacctatctttcaaattggccatatcattttgcattcctaccggcaatgaaggagagttcctgttgctccacatccttgtcaccatttgttgttgtcagtgttctggattttggccaggttaataggtgtgtagtggtatctccttgttgtaatttgcatttccctgataatatatgatgtggagcatcttttcagatgcttacttgccatctgtatgtcttctttggtgaggtgtctattaaggtctttgacatcttttataaatgaattgttttcatattgttgaattttaggagttctttgtacattttggatgacagccctttaactgagatgtctgttgcagatattttttccagtctgtggtttctttgaattcttttgacagtgtcttttataaagcagaattttttaattttaatgaaatccagcgtatcaattctttctttcatgaattgtgcctttgttgttttatttaaaaagtcattgccaaacctaagtttgtctagattttctcctgtttttatccaggagatttagaattttttgttttatctgttttccattttgagttaattttttaaacaagtgtaagatctgtgtctagattctttttcttttttctttttcatgtggacatcaagctgtaccagttgcatttgttgaaaagactatcttaattatattgtctttgctcctttgtaaaagatcagtagactctctgaagacagatctatttggaagctctctattctgtcccatttacttggagtctattctttggccaataatacatgctgtcttgattagtgtagctttatagtaattcttgaagccaggtactgtcagttctccaactttattattttactccaatattgtgttggttattctgggtctttttcctgtccacataaactttagaatcagtgtctcgatatccacaaaataactttcatagctttcagggattttaattggaattccattgaatctagagctaaagttcagaagaactgaaatcttgacaatattgagtcttcctgtttgtgaacatggaacacctcttcatttagttggttcatctttcattttgttcatcagttttacagtttttcttatattaatcttgcacatactttgttagatttatatctaagtatctcattttgggagtgctaatatcaatggtactgtgtttttaatttcagtctccacatatttcttgggggcatatatgaaagtgattgacttttatatactaactttgtatcctgcaaccttgctataattgcttattagtccaggaaggattttttggtcatttatttcatattttctacatagatgattatatcaaatgtgatatgtgaacaaagacagtttggtttctttcttcttaatcagtttgctttttttcttgtcttaatgcattagccaggctgtttagtacagcgttgaaaagtagtggtacaaagagacatccttgccttgctccctagttatcttcttttttctcgttctttctttttttttttttttcttgtttgttttctttctttctttttttcttattatagctgctctagtgggcctaaaatggtattttattaaggctttatgtattactaatgattaataatattagcttacttccatgtgcttattggccatttatatatctttgagaaatatctattcagatagttttgttttaaattgggttgtctggattttttgttgttcttgagttgtaagtgttaagttatatattcaagaaacaagtcacttatcagatatataattggcaaatattttatctcattctatagattttttttttactttctcactggtgctctttgaaatacaaaagttgttaatttttatgaaatccaatttatcaatttttttatttgttgcttatactttaggtgttatatataagaaaccatttgcttaatccagtcccaaagactatgtctatgttttcttctaagagagttgtaacttttacctttagggttttgatacatattgagttattttttgtatgtgatatgaaacagagttccagctgtattcaattgtgtgtggacatccagctgtcccagcaccatttctttaaaatactattatttcccctattcaatggccttggcactattgtcaaaaatcaaccaactctaaatgtgagagtttatttctgaattctcaattctattccattgatctatatgtttatctttatgccagtgctacactgacttaattgctgtagctttttagtaagctttaacattggaaagtgtgattcctccaacttttttctccttttacaagattgtgtggctgttctgagtcccttggatttctatgtaaattttataatcagctggtcaattcctgccaagaagccagctgaaatgttgataaagactgcatcgactctgtagaacagtttgggaaatatgaccatcttcacaatattaaattgtccaattcatgggcgttggccattttccatttattaatacttaggtttttcaaatttatttcaacacttttgtttttagagcataagctttgtaattcttttgtaaaaagtagtttaaaatattttattcattttgattgtattgtaaatgaaattgatttcttaacttcattttcagatttttcattgctaatgtatagaaacacagttaatttttatatattgatcttgtgttctgcaaccttgctaaatttctttattcattctacttgcgtttttttattttggtggaatccttatgattttctatatgtaagatatttcattcgcagagacatatttttaattgtttctttccaaactgggtgccttttatatcacttcttacctaattgtgcatattgcaagcttaaatacaattttgaatagaaatgtttgtgttcctggataagaaaggggaggcgagggtgtaattaagagctatacattgtgtcattgtgtgtgaggggttgtgtctccaagatttttgtaaataaaagtgaaatcttttatatatgcagataagtttgtttttatttaaattcacaatgaaagatatatacatatataacgttttatatatatatatgtaaagttatatatatatatatatacacacacacacacacacacacacacatacatatatatgggctgtcatacttctaggcatggcaaaatccgaaccactgaattgcaccttctagttgcttcctaatgtgactcacctgtctagatggcctgtctttctgtaggatattctatttaatgacacagggaaatttactcatgtgaacaaggaacatatgaatagtagctgatttaaaaacggtaagtggaaaagcttattcacaaaatgacataacttagagtggataatatagttttcttcatcttcatgaaggactgccatgaagaagcagcactggatttatttctgctacaaggaagaactagaaccagtggatgtgccttagagagggatattgcaactcagcaatgagaaggtctttcaaataccctacctgttccaccttagagtgagctctgtgttggtttaatatactccttttcataagcttcctgaatcacttatataatgtgaaaaattgtactcagaagtattatgatcttaagaatttaataaactttaattaaaaagcagccattatcaccaccctcaaagtcaccaaaagttgtctttgaattaatttaattttataagacaagtgccaccccaccttgggtttcttggagtgtgcacatagactttgggtgacattttcttttgtcaagagatcaagtcgaactttccacttaaaaaatacaacacaaaataaatctgattattcactggggctgttcaccctgccaaaaagttcagccttcaatggtgaggccaggtttcctctcctgccatctgttgagcttggctcagcttcctgcagatttaaatgcttcctgtttcagaggctttggatttcctttccctggatgccccttccacccacagcaaagctgcaagcctctctagttctctctgcttcgaccgctctgctgtgatgctaagttttcttttctggatttatagtaaaatttcttctgaggtgaacgcagtgcctagaggagactgttagtgtatgtttgctttgttcttaattagccaccttcaaggaaaaacctcctggcctggtttattagctagctttgtcagagcttgtctgctttatctaaacactttgaagagcctcttcaaccatacactgcctatatgctttcaatatacattttcatagtactggtcaattggaaaaaggtagaaccagggtagtacagaagtaggaaggcctcagggtaaattgctaatagtgggttaggagagaaaagggaaggaaggaatgggatagagtggagcttcacagagtggcagagaccactaccctttggattcatgctgtctagttgctattcagtttttggccccaattctgcttctgggaaaatttatgattgctgttttgacaagtcatcataaggtgagaaaaaatgggtggaaaaattctccctgtggagttctaaatggttacagatacgtgtttcttcctgtcagaagtgtagtttccaatactcaatgaccaaaacagaaagtgctttctcctcaaactctgaggagccaatgacccctttcaaaatagggcttttttccacctcccaaccctgccccaaccctatcagagcataaatacagctaatcaacctgggtgcagttgatgagctcaataatgtctcttggtcatcagtgacagcattgaaaacaattgcttggcttcttgattctcactcctgaaaatagtcctctcacttggtttctcccttgcgttttgaggacagtcatagagacactttcctcatgtctgatgccccaatggcccacccacttccatctctctgtgatctatttttctctgtttgcaccaccatcacgatcatcatcatcatcatcatgcattttatgtttggtttggttttgctcatgaacatcacctctgatcttcacccatgcgttctaaggacaagaccaagtcatgagcggacattaactgtgctgtgtcaggaaggacgataccactcatcagtgaatggtgccagacctcatttggggcaagcatcttgtgcaaactgtaccaaataaggtgtgtagcattaaccttattgctaatatgcattgatgacttagaagtatcaacaggtcaaatggtgttaggatttttttttaagcttgacaaatgaaggcctaagaagagcaaagtctcttatttcttagagaagcaaaatctgaagccccaaaatatttcattcctcatgttcatttaccctggaatgaaggtgatattacaacaatcagtgatggttttcaaaacatctcaatatgttggcccctaagcatggacaaatgacagtacaatgaaatcaagtaggaagcagtgaagaaccaagctaaatatgttgtctcctacaggaatcaatggatctcctgttaatagagaggggttggggctgggtgaatatggggataatagagggtcgtggaagagctttattggtttggaaacaattctcgctctcttaattacctcctgatgatggctgcagacagcaaagtggtggtcctgctgagattttccggttgcttcaagagacttggagctacgctaaaataacaaatatgttttaaatagcatcagctttacagggagccacacacagagagcaaggagggagatggaagtgtttgatttaagccgcttctttccaagatccacaactacttcagtgcttaatgaaggtgggagatggtctttgaaaatgctttagattgagtactttaggaccccaaatgcactagttgtttcccttgcgtattactgccctgattcttcagtgcacaagacgaataatttactaaaaagcacatgtaagtatttctttattattcattataatgaactgagacaggagtaattctccactctgctgcaatccccgagggcttaaccaggctgtgctttgctttcccacagttaatttgagtagaaggggacccttctctttgtacctgtggcctaagtaggacttgtgctagtctaggtgtgagcaggaaaaggagaatgagagaccccagctggactgatggcaagggcaatgtgaggtcaagttataagagcacagacagcagatctgttgagtgccaaatagggaagtgttacaaaagaatcattacagaataacaggaatctgtagtcagtgtgctgaggaagtgcataataatttcaatagtcacttgagcagaacacaattaaggtggtgtattggctgtaaagtacagagtaaattatacattttctacatatgcatttctaaagatttatttcttctcgttttcttttttctcttttttttcttccttttctctctccttctctttctttctcaacttatttatttaaaatccatgataaggaaactcgactttccctacttataatgaaaatttgggttttcatgccagagcttcttaaacccttacaagtttctatggaaggatcctcctctacagagagtcccacaagctcagtctttcttagtgtcttgcccacatgttgagtgctgtttcatacatatgagtaaaatggagaaggctggagaaattcaggttaccttcgggtcagactccctgttattttggttgcctcggagcagttcagagagtctcagcagctaagaataccctcttcctcccatattagcaatctggtggtgctgatttctaggtgacacaaattaaaagcagcaactcttggtgcctgaactggaaacatttgcaagttaaccctgtggctttattgcctccagggaatatctctctgggcttttcatggcccaaggaaagagttttgcctgccttctattttattttttaggagagacagttcgcataatctgtataaaataagccactattctggaaaagatgattggcttattaaaaatatatagcatatatttttaaacaggcagagttgacattctacaggagcaatgctgtaggaacggtgaagacttcacctcccatcccttctccgccatctgtccctgcccatctgtctgtttcatgagagttttatttttaaaaactcaaataaggttttgttcagatgtgtaatctgttcaggatggcacaggatgaatcaaggaaagctactggcctactagttggccattaagccacagtcacctgaacacacacaatttctgttttctaaacttgaggcagcacagtctatgggttgtgattggaagagatggatgtcctacttaattttccaaactgtaaaactgatgtatgtgtagatggagagatgaacactaggaaaagttaagatcattataacatgaggggtatcattactctttagtagtaagtaattatgtaaatataatagcaaacatttattgactattcactatgctccagaactgtggcaacagtgctaaaaaaaaatagtttctttggatattcactacaatctatagtttttgttttttttacaaatattatttccaaatgagaaaactgatattcacagaggatcaggagtttagtaaattatagacctgtgactggaacttatatacttcttattaaaatatttattatcttaccccatatgctacacagaaattttatggacagaataaaagcaaatcaattttcagtatattttttggttccataaataaatcagtcctttagcagttctgggtgagtttcatttgaaccaaaaaggggaggaggtttgtttatgcacagttctggagaaagaagaatggcctttgtggtcttgcccgtctgtgggattctgtgatcccgtacattatatgtaggcaggtatttgtagggaaatctgtgggctgtaatttctgcactgccgaagtctttgctcccacgatagttgtgcgggagcctgtggctgacttgcgccattcttcaaaaagatatcaagctccccagactctctgcttttaatttaaaattttaatttatacttttccatggatgatactgagacagacatggtcgtgagtaaatatgtcaggataatctattgaatggaattaaaatggtgtgtgcttgggaaacattttaatttcatcttgctcacttctttgccaagcataatgaaaaaattgggaggctgaattttaaagctgttcaggatgtggaggaagggagggcagagtcagagccagatgacaaataaataacaagaattgttctgggtggcttcttaaggcatccctgactagtcagtgggtagctccctaaaaggctctatataacaagcaggcaggtgtgagagctataccttcattgccttttacaactttacgtggaactccaaaccattgctgatgaccagaggggctggatattgggaaagatggaaaatggggctggatattgggaaagaagagactttttatcattcttgcctcaaaagacacttttcttctatacccaaaagctcattgcttcagaaatggctttgccttgtactgtagcaccaccatttaagtgagtcacgatggaagaaggtggacataaaggtgttccaaagccagactgtgactctaaaagaagagatgacaatacccgagcagcttgctcagtgcatttttctgtggagataccatttgctaaaatctgtggttactcatctttcctaagatgcagccccattactgactccaaaaaactgcttcactagctaatggtgtcaccttgggttgggagtaagacccttagaataattttcccttttcccttttccatggtgcccagcagtatctgtgcagtgaatgtctccttagggaattggatgtgtttctctgaagctccttaacccattcacctgtgatctgattcccatcactccatgtccctcatctccttcagcgctgacacatggttggcatctgacttcaggaatgcctcaatctgcttgagaatggttcttctagactgagcagtatcctgtttatacactgacgctgtccaagaaaaggacaacactagtgcctaagctattggggcctgtgggccaactgaattctgcttcaggtgtgcacaattgtgttgattgatctcccaattatgtatttttagaaatacagcatttcaccaaccacaggacatcaatctagaaaccagcccatcaaccactgtgtcaacacactgtgaaaaaggcctgatcaaaataaaaagttaaagttgtctcagtggctatagctgagaaaataaacctcagagggaaatgaaatcccactgcagaattctacgtaggttgagtatagaacacttctggagagtaagacatttttgaaaaaacagaaaatgttactagaagtacgagaatctataggtagactggaacagccctagaaggattagctagtaatgctaaaaatgtaaatttcttgttatttctgattaataccacatcaatatccgtttttatagatttggaagtacagaaggagaaggcatcagaactgcttggaaaaggatatgcgaacggattcagtatcacttggttaaactcacatgcactcttagatcatagagcttgaattatatttgtccagatgaggcaacagtgctcgtactaatagagcaggcactatttaccaagtataattcctattctcaacacgcatcactttcttcagtcctcataatagcactgtgtaatgccatgaggaaaatacgttcatcccacttcacagatgcacaaatgaagattctgagaggttaaacaaaatgcttatcttagtgctctgtgttagtaagtggcagagcccacatctgtccaatgacaggcattctcctgaacaccacaatatattaatattatctctataatgctcgatttatacatttcgcaaaacctcataaagaactctcagctctcatcatcattcttgatattgtcaatatgaacttagaagaaccaacttgcctctaagttagttcacatccccatcattgacaagggtgactattgctcatttcacacttatttcaacttttcatcgtgtataatttctttcattccagctgatttgctcaaggactttattaagacttctaatgcattgagcctaccacattctctgtatccgtcagcccctcctatcttcactatttttattcaatattttgtaattcctgtaatccttgccttcctccctgttgctcacttggcgtactccaacacgggataaacccatcatctacattctctatgcctgaagctaggcattgctggagaatattctcaaagctagcagaatattgtcactacaaattcttgaccaccaactacaaatgggacctcaacatagcctataagtcccactatagttccctagtagttttgatgtcattttctgcgatagttatttcacttttttgcatccttcatcccctttcttctgttcttccatttaccttcaactgataacttagtcttccactttggagaaaagattgcctcctggctttcccatagctgaatccacaaagccacccaggtttctcttattttttcttctcttatagagcagatagagcatctttccttcatatactttatatctaatgttttctcactttccctgtaacttttctctgacagttatcccctttctcctgcattagcacttgctcccattgataagatcattctcattagtatatatacttacatactgcaatgtaagaaggcctggtccttgtctcatgcagttttgtttctactgcctaaaatcaggctactcaaagttcattaagtcctcagcatgtgggcttgttggaaatgcagaccatggtccccactcggatttagtgaattaagatgcacaggtgatatgcaggctaacaaaagttagaaacatcccagcacccaataggtattcagtaaatatttgcaaaatgaattaattagttcccaagtgttcctactcttaaaacaaataagcaacaacaaaaaagcaaaacaaaaaccctttgaagaacctaattgcctctacctctgtgtcttttccccactccactttgacatcaaagttcgttaaagtgttggctgcaaacttttcatcaacatctcatgcctgattctctgatgactccttccttcactctagctccctcaagctcttccttaagcggcagaccctttcatcatgtgactgtactctcacatctatagggatgcaatggtcccttcactattctttctgcctctggccctgctacagtctattctccaaaagaagtccagcctattctcataaaatacaggcctatagttaaacctatgcagacattttaccatggagatgtctacctctgcagccctgtggaacacaaccatgtccttgtctatctcgcttggactactctggcttccactccattccttacctgagtcaacctcaatcccagaccccacatggctgccctgccttctatctaagactctatcagtacccaatacttgtacctagtttttcttctgagttatcagctttagatatttgtctgttaatctaacaattatgttacttcttcagagtggcctagtctctagactgcatgtgtgagtaaggtcttgcccatgccacccctacatgaccatctgatatggtgtggatgtgtgttctctccaaacctcatctagaaatgtgagccccaagattggagtggggcttggttgggggtgtttaggtcatgggggtggattcctcatgaatgatatggtgccctcctggctgtaatgagtgaggaatgatttctggctctgttagttcacaagagagctggttgtttaagagcctggcatctcctctctgtctttcttgctccctctcttgccatgtgataccaactcccctttcccttctgctatgattggaagcttcctgaggccctcaccagaagcagatggtggcgccatgcctcctctacagcctgcagagccgtgagccacgtaaacctcttttctttataaattaccagccttatggtaatggaaatggacgaagacaccatcctaattcagcttgtactcatgtatcagtgttctgtgactttgtgtattgcatattgctacctcaaatctgcgagcttcatgaaggtagaggtggggcgtctctcctaaatgttctatttataaggcctgacacagtgtctggtccttagcaggtgcttactaaatatttgttaaacaaatggacagatgtatactttttattgtatccatgaatgtgatagggtgcctttgtaatactcttgtgttctatcatttgtctgagatcataaggaccttcaaagcaggtattgccttttcagatgttttttgttgttatttttatttcaaccttgcctacctcttcttgggaaactagtaatgtgatctcctcaacataccctgtggatttatagagtgacttggagcctgggaagaaaccagctcaatcattcattattttgttcagagagctttctctggcctttctgctcacccttactttttataattgtgtttcgctaccctacgctttacttcttttaccaagataggaattctcctcctctctcctcccacagccaagcagtttaaccccacttctgtagttgtaagcaatttctgcctctttgtggagccatctttccatataaatcactcctttcattttccttcccggcatcagatactctgttctgagctgccgtcagcacagttgcctcacttgcgtggtgtgagaaattgctttctgcattcaggtagagccctcactgtgcttgtggggaccagagattccccttgtttgcgtcaggacacaatgagcaatttctggtggactcatctatcatcagacatggctgaaagtgcagcacattatcatccagtggctgattttctgcctcaggtgatgctgttttcaggaaagcctgcaacctcccttggttgtgtttccactactctatgtcctcatgttgcaggccctcacgttgaaggcattagtgtgttttctctgcataacctcccctcccgctccacacacacatacacatgcacacacacgtgggcatgcacccttcctatgtattaatgtgacatctcccctccagctggtgttagtgtggcactgtcttccaattttccagcgagtggcagatgtcatgttatgtcagatttcaaagtcaacccgttgcactactgaaatatttttgtgctgtactctccttaagtagctcttatccctcaccatttttctgcagaggctttcagatacattctcaaccaataccttatcagcaaatattagctctagcagagtgattactctcgttgcatttccaactatctgaatcataaagttttcccttacataatttagggtccctgttgatgctctgaagttggctctatttgtaactcaggaaataaatgagtagttaaagcctcctgggagaacagcttttgcaatttagaataccttgggagttgatctaaaaatatttcattttggcttgcctgttcttctttcccttaaaaaattatttatcactggtttatgagtttattaaagcaaggtcttcctcccagtttttggactggcattattaatatatttggatacatagtcaggtttttcttagcaaaaattcaattaactctcaatttatgaaaaaggcaaatgataaaaggaaaaccaaaaagttacaagataatatgggggaatgtattaaaaaagtaaattcagagaaatgcatttcgggctttaaaattccacccagcatttcttaaattgagtactctatagaagaccactttaaaagcaggggtcaaggatgggaagagagacaagattttcatggatttccagtggtaactattaaaaaaaaactttatatatgtgcaatcataaaactaggtataaatgccttaagcttacactctgatatgactgtaacttctgaaattataagttatgcacatatatagccactaaaatttaaacttggaacattaacttaatggaacagatgatgttttattaaaattaaatccactttgggaggccgaggcgggcggatcatgaggtcaggagatcgagaccatcctggctaacgcagtgaaaccccctctctactaaaaatacaaaaaattagccgggcgtggtggcgggcgcctgtaatcccagctactccagaagctgaggcgggagaatggcgtgaacccgggaggcggagcttgcagtgagccgagatcgcgtcactgcactcaagcctgggcgacagagtgagactccgtctcaaaacaaaaaacaaaaacaaaaacaaacaaaaaaaacaacattaaatcccaggttgcaatgtggatgtggcactgactgctgtaaggcctgcccttctgggttccacgctcatcctgtgataacgaagttctccttccacagtggctcattctagcgcttgggaaccttcattactacagtggagcccatatcattcagcttttgctggtaggaaggcgtcactgacaaagccagtcacctctgtatttttgtcatcagcctgatatgatgcaaggacttctcaatgtgccagtgtggtgaacacaggtgcaaatctgaacatttaaatttaattgttgtcataccacatctagcataggtttatattatacatctcccaattacaatagaaatgaaaacactaaattgaaaaatatacataaagagcccatggactctatgtgtgtctatgtagatacagataaagatatagattcagttatcctgcagaaagacacatatatgtccccacatataagtctccttatgtgggttcttttgatgcccatttgaaaaacattgtcttacaccttttatcactataaatatgtattgatgacctactagctcctgggtagaggctgggaggtgctggtgatactgaatatggttactatccatgtgacattcgtagtttaacacatgagagtataaataattaaattcagtgatgtaagctctatgaagagtctaggatctttggtattatccgtatattacaaagagaatggagtctgaattagagatttaactacatttgccattgtctactaattaaaacacaaaggtatgcaccctgttttaggtattattaccgtaacaaaggaggaaacataaaggcattttctagttaactctcagtttatcaaaatatcaattatcaattctttgaacacgtacaaagtcctcaatatatgaggacaccatttgtgaggctggtttaaaagacttgttctccaactacccagatcacttaaatgtccctgcagctatctgtgcctgtatgtgagatgagaatttcattgtaaagttagacacaattttcggacatgcatcttattgcacccaactttagagttataaacattcaaccattcaacgtctggcatgaggccatggaagggcatttcttgggaattctgttccaaatatatccacagttcccatgatacactctccattccttaccttcttttattttatccaggtatccttctgaaacaaatatatctagacatacatactttatttgtctctcactaggtgtagtttcatagggcaggaactttgtcggcctgttcctactgtgttctcagctcctaggaagttatctcatgcaccttaggcactcactccatatctgttgaatgaatcttggcactttttttttttttttttgcattttcaaagacaaaatataaaaacaaaagtaaagaacacaaaaaagttaaagccaattgattttaattttcagtgattattttgattaaaattccaacctgtcacttgcctcatttctttaaggcagtgagtggttctccaggaggagtccccagagccgcagtatccgggaacttgttgaaaatgcacattcttggtccctccagacccatgaaccaaaagctctttgggggctggcttcagcaatctgtttttgatgcacagaaaaggttgaaaaccactgctttaaggcatggatttccctaagttcacctcttcctctgaaaacaaaacaaaacgaccctgaatcttaaccccacggtacatattcagaaacatctctgccttctgatgtctgtcaggcatttctttgctcttccagactctcatttataccttctttcctcacacatggctagaggttaagaatgtgtacaagtgtcttccagatagctttccttttttcttatctgtgccttgggttcctcatctgtaaaatgtggatataatattaatagaacacatctcaaagggtagttattaggatagaatgatttgatatattgaaagttcttacaactatgcctggtgcagtacaagcaatatataattttagaggttacttgtgatgtagttgtaatgagttctgttttatcaaggatcagtaggtagggttagcttggaatgtaagaattttaaatatctgaaataatttccaagacatcagaaagttgtcattagccttcctcaacttgcctcttggctcccccttatttaacttcaaaagtgttcccctctgtgcttcttgttaatgagagtccaggacacggccacagacagcagggaaggagcctgagtttagaagagcactcaagccaactttttaagtccttccctgagttctctttcctgctgttcaggggactatggaagagtcctatggtgatggaagaaagcatgaagccatgaaactacattttcttttgaagcagagcaacatcatgaggaaaataactttcctcaactgatttcattgtttccctcagtttctctgttgttaggttctgagaaccatacaaacttgtgaaccatctttgcccatttagagagatggcttttactcagttactcttttctgtttctactccaggcccataaggaggcccaggtccaagagcaagtacaccggatcatggctactcaccagggagaggattacccaagggacacacaggctttccaagggctgtgtggctagggcaatgacagtgtgttctggcccacagagtagttttggattgccctttttcaaagtccacccttactcaagcctgtggccacttgcactggttctatgcaccctcaacctgaagtggttggtcctatacaaggacaacgataggattcaggaaatgcacttcaaagatctcaaattccctaaagttgatctgcttgagtaagtgcctgaggttgcagtgtaattctgtgtctcccttctgacagctcccacttcacacttcgtccaggagataaacttctttggctttctttgtcacctccatcagccgactgtcatggagcagggtatcagtcttgaaggagactcccacagaagcaaagcagggcactaaaggcaatggcacctgattgcatcaggaacagattcatggcaaactagtgcattctccatttagaattagaacttggagatgagacatgtcctaacagagggctcggtgatttagcatattaaaataaacagtatttgtattttcccaacatttctgagtgtattgggttaaacaaggcacttccagtaaaagaataacatctttttgcagccatctgataaggcctggtaaaatggtatcatatactttccagatactgagaaattgaatgaatttgatgccatgttataaacccctttgcgagtcaggtattttccaattcattgcattaaaataaattgaaagaggaattaattgatttgtcagctgcgagatcattgaaattatctttgaagctatattactatgtgatttttggcatatatcttggaaagcattcaaataattgagttggcattgctatgcacaattttcatttccatcttcttatgtgaacaaggtttctctaaaagcaaaagtaggaatagaattgatcctgaactccatctcattctagcagtgagtgatatttatctacggcatttaaaaaaaggggcctatccctcttattaaaagctatatttctagtaagtttgctttttcatgtttaattattgcttaacgaaatgtgctctatatttatgttctatcaattttatatttgtaatgatcattcatttaagaaatatattattgcttaaagttttatggtcataggacataaaagaaatttaaatttcaatctctgtatatttttggttgcaaataaatatggtaggtgatcaataaaagaccttcaagcataaagtacatttttctgcagaagatatatagtggaaaaacaagttccagtttaaaaaggaacaatgcacgtgttatgacttttagaaaaagagttagttcctgaattttgaaagcagataatcaggagtgttaatcactgtgatatttaaattctactgaacaaatacacacacacacacacacacacacacaggaattttgtgacttaaaaaaatttttaaatgtgaatatgttctaaaggccaaaaaaatcatccttttcaattgtagcttacaattttttatggcaacttaagaatgtgcaaggggttacataactaagcaaaattaaagcaatatttgtttgcacttagtcacttgggttgtgtggtgactagaagaccacacaactagaagcgactggaacatcacgcccttcactctgtctcaatttagcatctaattccaggtgtgctgatttttggaattctactatttgaactttctttaggaggagctcttcaaacagggatttctcctttatgaaaattcacctatccttaggaaaggttgcatatttccccttatcagtcatttgcaactgagaatgaataaatttatcatattttttccccaagaaaagcctttgaaagtggggagcagggaggatccattaacgtttaagatccattaggtcttcataagggaaatagaaaaatgctatggaagtaagaaagcaacaggaaaagaagcaagatgcctcacgatgtggaggagataacatgacttcattttttctttataccaatgacatttctataatgatgtgaaagaatcattcgatggtacctagattatcaggtcctactggtgaatgcagttgggccctggaaactcgcttacctagaaagtatgcagattgaggtctgtaactgctggtgtgcaagggatgcctgtggtcaaataaaaaaaaatagtttcattggaatgttagagtatgattctatttcaggtgaaagcaaatcagcacaagcttcatacaagttcatgcatgtgtataaggagtaagatgtagactgagatataacaagttgctagcaaatcaccatggggtgctgggcattggtgaggagtgaatggttagatgggtctgtatcatcttagtgttatttacatgcattattcactttgtattgttcacatgcttatttagaaaagaacaatgtcttcctgcaatattgtgagagtgcctaacaccctccctacccaacttctcagcggctaaagggcagatgggccagctcataaaaaggcctgggtgaccggaagctggtattgcttttattcttcctaccaaccagggagaggaccgccctagatcaggtgctttccccattctagagggtcatggttctggtgcttggagaccctgagccatgcaggccaggtgagactggtcacttggccaggtcctgacatctccactgtggccagtgtctctggggtccttccatctcctgagacctgcctgaaggatcactgctgccacccaagtgttaggtcagatccagtgagggaaggccatgcctattccccgtgttctcctcacctgcaggtgctggactcaagtccctcctctctctgccaggacattggcaagagtggttgtccttgtgcattcctatgtgcagcatggagtgatgggtgtgcctccacacttagaaagcattctgtttcctcatgcttccattcccacgtcctcagttcctgggcacatgcgcagacgtccaacactttcagtcctatatcagacctgacagcctgcaggtcatccacactgacacacaggccttgtttgtgttcatagctttgaattgttaaggagagtaggtgagaggtgttgcacagttccctgctttgataatagccttgttctgtctcccaatgggacagggagtgtatgaggaacagggattctgctgataattttctttttcctctcctgaagtcctaagatgcagttttgacttcctcaagaagtgttggctttctaaggtgaattttaccaacctatgttataaattgtagtttgcaggctttcggctgcttaggggtataaggagattaccaacaccagggaggtctggaggtaaatatgttcaatttttgattaactacaagttaagtatttgctttgtgggttatctgtgacctatttgaaatgctgatccactctctctcccatgtgcccctgggccacttcttccccaaggtggtaaatgtgctcaagaaacataaactgattttcatataagcctatggggaaaaaaataacagggaaagcaaatggatggcaaagatacataatatgtctcgaagtcaaatagaaatgattttgtattgtcagttcttcaagatgattctggtcactcttagtttatatttaggaagtttcatcaataattgtttccttttagcactgtgttttgttgtttcatttactcctcaaaatgcaacgtcttatttaccatattatataatctctccactctctctctttcccttcttcctccctccaccactccctgcctcactgcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaaggtaagtcccagctggatctggggttgccattcccgtcagtgatggaggggaagaacagtgttggtgtttgttctacctgtgtgcgaagacacaaaagtcatcttcctctactgaattcagagtttgactatatgtcttggaatgtttcccatcgaatgggtacttaactaagtgctgaatatcttctcaaagtttctaaatgttatctctagtccttctgttctcatcaatacgttgtgtaacatgcactcgtattgagctctcgtaagttacttagcactctggagctggagtgagatacatgcaaacatagataaatacagtactactctcagtgccttttaattctcttataggcttatttcatgataaaagacgaataatgccaatgagaaactacgtgacatgactgttttcgcacagttgctggtcatgcatgctctggaggggtctctgagtgctgtttaggcaggtcctccctggcattgctgctgtctttaaacactctctcatagccagacaatgaagtccagatccaagagggatattagtcagaatgatatctgcaggttaatgttagtaataaattcagacaattttaaaaagggagaaggaggaaggaagacttagcatcttcttccattctcctttaaaaacttgaatcgacatagcccaggaattgtgtcacgtgcattttaaaatagtttttaatttaaatttcatattacacctcaaaaatggggctgaagaaatgtcagattctcagatattaaatattaagaattaaaaacacatgcagatagcagttccaagaatttgagaaccattttaaagcaaggcagcaatccaaatgaacttattttgaacttgaccccaactatcatcaccatgtaaagccatttctgtcaggtgttggctcacggcaggaatgaagttgtaagcacattagttccgtcagccagtgatgcatccttcctccaccaaatgaaaggttcgggtggacttctttcagagcctcgtttgcagatatcttgaggaaacacagtgagctctcagaaagggtccctatgtgtgatttagtctttagcatctgccttttatcagatcccatctgtcatagatccaacagaattttttttttttttttagtttgtgaaatgtgtatggcatccttgcttagctaagatagattcctcatctctgatttaaaaaaaaaaaaaaaaaggaccacgatgttgctcatttcaattggtttcctagagagaggttgcgtgggggctgtctattcatgcttcagtcacttgcatgattcaggttgcccattctttccttttggcgcaagcagccaggcctgcctctgtagccatttgtaatggcatgtgtggggccagagagctgtctgctgtcactgctgttccccagcagtccttggcactgccatgctgcctgaagctttgctcctgcccagcctccaagccctgctcccctcctcgcgtgctttcaggcgttcacacacgccatccgacagacatctacagatgctgcgggtttccactctccatacacgtccacccacagctctggagtgacaagactgcctgccatctggagatcaagacaactgtcacatctgatacttctcctcagaggacgacagaggcacttggtgagatcagtcatcggagatgagctgggctatctgttgaacgtttctgagggtgtagaaaacaaaagactgtgagctctcactaccccacctgcctgcacctgggcttggttccagaggagctgacattctcggcatcggaagtgccacctcagtggcacctctgtggccttgacagcaaagttattttcaaattcaggaaatgtggcaccgaaataaaaaagaactgtcaggcactgtagagaaacagactcaaacagagcaagcctatcccttttcaagaacgaagatagatgatataagcaaatcaaagtcaatgcacaacataatgggctgggggctgagcaacagagaaggatgttctccataacacatgctgagcgatcccttgggtgggatgtggcagcctgtggggtctccctgtggacctccaagcttcaggtcagaaaaagtctaaggacagcatggcatctatttcagaggtcagctcctcagtctccgcattccaggccaagctactctctggctccagccctctgaggtggcctgggaagtccagaggcagtcaggatgggtgggggtgggaggggaggatattcttttggggaggagcttctcttggggaagagcttctcttggggatgatgttctcttggggaggagcttatcttggggaggagcgtctcttggggaagagcttctcttggggaagatcttcttttggggatgacattcctttggggaggacattctcttggggaagatcttctcttggagatgatgttctcttggggaggagcttctcttggggaggagcttctcttgaggaggagcttctcttggggatgatgttcttttggggaggaccttctcttggggaggagcttctcttggggaggagcttctcttggggaagagcttctcttggggaggagcttcccttggggaagtgcttctcttggggaagatcttcttttggggatgacattcctttggggaggacattctcttggggaggatcttctcttggggaggagtttctcttgatgatgacgttctcttggggagaagcttctctttgggaagatcttctcttcgggaggacattctcttgggatccttggcaggctggtttgtacctttactgagaggccacagagaaggagatcagaaagctgaattatttcctcttgcttagtgatccagtgacttgctctttctttggaagacagttgaattaccagagggtggatgtagagaccccactactcagttagaaagaagccccagagttcttctcccagcagcatcagcttttgtccagtctatagattaatttttcagacatagtgttagttcaggttagataaagataatgaaagtttcctaatcctcttaaagaaaatttatctgactgagtagaaagcttttggaagacaataaggcatgtataaaactgaggcctaatcttgcctttaatttcaaactgctgatgggtattgattttgcaatgagagaaaacagaaaaatttccgagctgccacttgtctgtttataaaaacaaaaggtgtttatgtatcttctgtccatttgagaaggtgggtatctcatttcttctgccaaccagatgccatcagcagaagggagtgcacgcctaagggactcagctttatccctcctgccatgggagcgcctgagagacactctgccaccaactttcctgcctgccctttcctgttgtagaaggcagcctttgccacatatctgatggaactaatttccaaatccttctcattgagaacagaagctgccttcattaaaatcgtgtcactgatacctgaggtacatctcagccactgaggggatcagcacaggcaccgtgtgagcatgtgataatgtgatctaggctgcacacctcagtgtggaggaaatccggagcaagggggatgctcagctgtggggtcggattagttggggggaaaatcagcctggcagccccgcagagcaggagctaaagcgggagaagctggaggcacaagcgcaggcaggagtgactcccatccccgctaagcagtgcagccagggtgaccgtgggcctacctgaaaagatccagaggtgcctgagaggcactgtccacaggaaactgagagcattcatcctcatacctggaaagaggaagaattaaaatgatatcacccagattttttagtttggagaaatgctagtgattggggagatacgatcctatgccactcggaaagaacagctttgggcttacgaggtctagagataaacaacacacaaacattacacagatgttgcagaactagggaacaggtgtaacctaacaccagaaagggcatatttgagattcagcatgaatttcctggctggagagtaggtaaatgttctgaggttaactattcgtagataacagtaagaatcataatttatttatatccaacctcagcacttagcacaccgtctgaggcacagtaggcactcagcaaatgtttgtacaatgagcagaagcagattgatgttgctactggagtggcataggaacacagcgatcataaagcatcttcctgcagatacaggtggcagggaagtcagactatgtccagatgactcggagaggacagtcatggaggaaaggtccctgaggggagagggtcctcgatgtgacaagctaagagattgttctaaaaggataacacaaattccaggcatttatttagtactttacagagatggcacagtgtttgtcacctttgactcacacaacaagccctgggaggctgtagtgcagtgaccgttatctccatttacaaattaggtaactgcagctcatggaggttaagagcctggctgagtccccagtgagtaagtagcagagctgggtcttgaaccatggccacaggactttcagagtagtgtcttttcagcattctgcagtccctccaatgccaacaacatccaaagttagttctctgctctagatcaatggaacattttcaggatttctctctctgtgtgtgtgtgtgtgtgtgtgtgtgtgtgtgtgtgtttgtcattcttccttctattgatattgcattgtagcaacagaaattgaggacaaagctcaagaaagaaaattagtggtgggagtgggacaccaaagctacaataaatgatgtagagaggctgtgaggggggcaaagagaggataattaattttctagtagctcatcccttcagggatatgcattttaaatgttaccactttatcctatgtaagtactgaaaaccctggaccctctgtggatccagaatctcattgtcattctaactgtcatgagctcttcagcactctgaaagaatgcagagatctatgtgtgccagtggtatgtcattgtcgttgtttgttggagatagatggagtaagaagatccgtctatggttgctttttggatgtaggtattctctacctgctttcctgccttgttcagaaatctcttcactacaggttacttccttttatggaatgaactcctcttgctaagcccaattttatgcaaagggctggaaatgatgaattttattaaattcttacataggaggctccacagcaagcttatgcaatttctatgtaaacaaaagactctacatctcttagcctggtgtcagttcaggtgaaattggttggtatctgaagttgagttttgcttgtaaagaaaaatgtgttcccagccctgccagtcctagatattgctgatcaccaaccaacctcagcattgggtgcactaagtataaacgttatctcagccgttccttacatctatccactctacagaatatccaccctagtcatgtttacaaataaggaaatggaggcttagaaagattaacaacttacccaacgctgatgcagctgccgcgtgctttaaatccccttcactagacttactcatcgaggttaagcttttctcacgagaaaaaaagttatcaaaatacaaacagttaacaaggtactttatatgcattatctcttttgattatgcttcccaaaagccccacatgacagaatagaaaggcacacctttccaagaccagaaagtgagattcagagacttggaagtgatttgtccgagttacactagcgaggaagtggcaaagcaacacccaagaccgggtatatttactctgtagccaccagagtgttcaacacaccactgactcagagttaaatacgtagacaggtacttgttcttatgtgagaaaaatgtcaaccttcagaggtgctccagaaaagggtgggccctgaggtgacaattctggggttggggcagcaggtggatgctgggattgcaccaaggagcggttgcagcaggcccagggaggcagagccataggtcacaattttgccagggatttccctattttcaactctttgtaagcaatctctttttttaggctattttctcctcttttcctaaatattacccaaacatttaaatgaacatgtgtgcttatagacttaaagaaaagcaggcagttaacctgaaataaatttaatgtattcaaccgctacttaaaattgtaatcacatttactcttcacaaagacaggatagaagagtggaaaacaacaggacaggccagcagaatgctcactcctcagccctgcgctcggctcctaaaagtgcaggcctgcatctccaagacgttcctctcctggcttattaacatggggtgaagagtagaattcagagtaatttatttatgtgcacatatgcatactttaatcccatgtgtggctgtgtgtgttttttttgtgtgtgtatgtgtgtgtgtgtgtgtatgtcaattggaaataagattctgagaaggggtctctaagctgcaaattctgtatattagtgcagataaagcacacagccaaaattaggttaaggacttttctgggcgtcatgtccttgactttgcaatggaaaggttgaactgatgatatgaaagtcctttctagttattctgtgtgacaacttgtcagtgtaattcatctgggaatttgtgtgtgaccaggagtctctgcactctgtgtctctcctactttcacccgccgatggcacaattactaggttggtgtgaaagtaatcgcagtcttttgccattgttcctactatttcttatttgtatttttctccagaggctttaggatttagtgtcccttactaacactgctagttaggggtgactgtaaaccttgttgttcactttttggttagagaaggtggaagagaaagataccatttgcttccaagttcttctctaacatttgtaacctccacaacccacgtcaagcggacacatatttaatggacagtggggtggaattccagaggccacagaggaaagagccatacaacctataaaaactgtgtgagtgtgtgcatgtgactgcagaagaaacagacatgaaaactgtgtgtgtgtgtgtgtgtgtgtgtaacagtgcgtgtatgtgtgagggcattcgtgagtgtgagtgtgtacgtggtacctctgtatgtcttagttcctaagcagagcagaacaaccaacatatttctcctcacaacaatgggagaagagacctgatcaatggagaaatcatcaaacatcaagcatatatatgtatacgagtatataaagatacacatatatatgcttggatatacacatatacatgttcaatgtttgaggtgtatatatgtatatgtgtatacatacacatgctttatggaagagttaggctaactaagaaggcaactacaacacagaaggaatcaagaatgaagttactgtccagaataccctctataacacataaaggaagggatctcaagtctcccttcactgggagggtgtccccacaccaccttctgcacctgccccgccccctgcgctcagggttagagcaaggccacactcaccccaccatgccgtggtcctatcccggctctcagactactgtgtttctcagatattaacgaatatgacaccttgcgtagccagagtataattgacgttgaccttcacgcgtctcctagattgtgacctttcatgacattgtgtgtggttggtgacaacacagttcacaacacagtttataaaaaaagaaaaaaaaacagatttctccttgtatcaggccttttctcccactgttgtgaagatacatgtggggctttgttctgctttgctttgcaactaagacacacacagacaccacgtacacatacacacactcacagacatactcacgcactcacacatacacacactcttacacgcacacagttttcatgggttttgtctgtttcttctgtactccacacacacgctcacacagtttttatagggtttatggctatttcctccgtggcctctggaattccatcccattacccacaaatatgtaggctaagcctctgtctaggagacgagagggggaaggacacactccatttctcctcggacacttatagtctatttaattataaaaataggaggagtcggtattttctaaggtgagtgagaccaaaaaaaaatgtgactctggatgaatacattgtcagaacaaatcacgggtggaccctggcaagaggcagcacttccgcttgagagtcctggctgggaaaaaggcagagaaactccttgatatgatccaagaagaggctgccagtcctggcacctggtttgatgatgatttttacagtagccagaaaaaattagctgggcatggtggcgtgcgcccgtagtcccagctactcaggaggctgaagcagggaggcggaggttgcagtgagccaagatcacacccctgcactccagcctgggtgacagagcaagactctgtctgaaaaaaaaaaaaaaaagacagagagaagtgtcagggcctggggctgtcatctgccttatttgcaatagaattaaataaacggaacagtcgtaatgcctgttctcaaaatcatcactgatgtggagatggaaggaaaatgaaatgcctgttatgttctgctgaatttgcatggtgatctcagcttatttccgaagagacctgtctgccaatacctccagtaaataggtcttttcccacacgttcctgctgctgtgagcaggggagcaatcacacctcagaagaaggacaaattagtaaatgttcataaactctcctgatagattaatgtccaccatgaccctcatatagtgaggatcttacataaggtttcaagcctcaccacccgcaagattagtcagtcactgtttagcatccaagtaaactgtgaattcagaatagtgatgtctttctacacatagcaggtgtacacagatttggagagtctcacttgcatttccgaacctggttttgagctcctagttaacaagtattaccctcaaacatagtgccttgacgaaagtaactgttgtccctattcttattctggcttctcaagaagtcttttactcttcgttcactaaatttctcctctataggcatagaaattgaagagcaatagaagtgaagcaaaataatcaccaggaaaacagtcaataatctttttcagtaattataaacaatggttatcatctgctgagtacggttgacccttgaaccatatgagtctgaaccatgcagttccacttatatgtgaattttcttccatccctgccactcctgagaccgcaagacctacccctcctcttcctcctcctcctcagcctactcaacattaagacaataatgatgaagacctttatgacgatccacttgcacttaatgaacagtaaatatattttctcttccttattatttacttagtctcattttctttactccaatttactttattatatgaatacagtatataatataaatacaaaatatacattaatcaactgtttcatattatcagtaaggcttctggtcaacattaggctcttagtagttaaatttggagggagtcaaagttatttgcagattttcaactgtgtgggggtcattacccccagcccttatattattcaagagttaactaagtggggtggcggtcatcttataaacattatcagattctattttccaattaaccccagagggtgggattcatgttcccatttttttgaatgagaaaactaaggctcagagaagctaagggccctgctgataagtacaaggttgtatcttaaactcacttccgttgacagtggaattctccactcagcttctagcttaacttcctttcaattctccactcagcttctagcttaacttcctttcaattccatagcttttaaataagtaggtcagactgccacgccaggtcatttacaatacacatcctttctgtgtcaggtcaggttgcctctgcttaaggcattgtagtctaatctctgtggagtcagggtctgtccttaaacttttttctctcttgttttgttgatcttgtcttagtaattataactttttttcttggagttaatatcagctctatatcattggctcctaaatctaaatttccagtttttagttctttcctaattccattctccaatgtttgattattttcttagctcctcaacttgggtatcccttaggaatcttaacatgttccactctcaacttatcttcttttctccaaaacctgttcctcttctcgtaattcgcatttctattcatggaaacaccattgtgtataaaaccttggcttcagctttgactctttttctcttttgcttctctatcaaagcaaatgtcatgtccaataacgtcattctctccctttccgttcccacaaccactaccttcaaagtgcagaatcttactctctactgacttttgcctgtcacatcctaattgatacctaatcctcatctctcccgccctataattcattttaacagtgttgtctaagtatttctgatgcagatactgatcatgtcacttaccccacttgtattttaatggatccctgttgacaatgaagtcaagtcaaaagctcttagattgtctttccaagtgctgagcaatccagggccaaaccgtcttttctattcttacttctttatttcttttttactttttggtaggaggaatgtttctttctttttaaatttttgtttccataggcttttggggcacaggtggtatttggttacatgagtaagttgtttagtggtgagttgtgagaacaggtggtgtttggttacatgagtaatttgtttggtggtgagctgtgagattttggtgcacccatcacctgagcagtatatactgagcccaatttgtagtcttttatccctcacccccctcccaccctttccactcttatttcttatttctccacatttacatcctacacacaacctagtcaagtttgtccttgtgtaatccccgctgcccagcatcctgcattcttcttcgtttctcatagaattcatctgcctttaatgttcttctccctggatatccaaatcctacagaaagcagtactgtccaatagacctttccgcgatgacggaaatgctctgtatttacactcttcaacgtggtagccattagccacaagtgactgttgagaacttcagttgtgactagtgtgactgaaaagccaagtctttagttttatttaattttaattaatttaatttgaaatagacacacatgaccagtagctatcatattgcacaattttagagttgctagggctttttaaaaaaattccagctgccactttacctgtacttccttgtgatacctgtagctttttgtttcaaatttcagttattggtggatgtaactctcttgctctcctagactgtaatttccttgaagacaagccagaggaggtggctccataatttttcacagaggcacagcttagggatagcaatctgaattggcatgaccatagaagtctctctttcacaaattcatataaaaggttattaatccataaaaataatagcaaaatgtcttaaatatgcttttaagattttaggaaagattgagggaaaatgtcagttattcttaggaataaataagcatctcaaagggcagcttagtgggggagatattggtagccacatcatgaaaagccacgtccagcatggatttattcccttcaagtcctttcccttgggacagatcactgtacactgtagcattgaaaacatgcctgttgaataaagaagttcttagtgaaaccttaaaaagaattccttaatttagggcttctggggaaaatttctaacacagtcactttgctttagcggtgtcaaaaatcacccctaaacaaggtgccctgatggttgccctggcaggcagagctggaagtgcagggacccagcctgctgcaatcaatttaatgggatggattatgtgctccgattggccagtaagcagacattaatgaccagttagcaactgtgttcaggtcaattaatttatatttgtattttgcaaactaaaagttgctctgttagattattgattctttgtccctgtattcaatttgtttttaattgtaccattgctgggccaagccctccctcctggcaagctggcaataaatctgccaccatcccaacaatcaacaataaatgtgtctcttcatgtcattattaatatgtctcttggattggttcattaccacggttaacagtttataagggtcggtggcacactgccaggaggattccttttcccaggggctagtttgtcgtgacaggattgatgttttcaggcctgtgtgtgtctgggaaagggatcttggatttaatttaatatagctgagatacaagctaccaaatcctctttttatcataaacagctttagaagatgatatcgttgtaatagatatttgtaccctctctttcaattcttctttcttttaattttttttctttcttattttttcttaatttctgttcagatagattatttccccctcagacacaacataacagctccccgggtaacctaaaatccgcaggtaagcgagccatgcgtcccctgggagtccgagttttattactgggtttttgttagttaaaagcagagaaggagttccctctgattgacagatgaagggtgattaacagagctgtagaaatactgctcctagaatgtcacctaaatcgtggtggtgcctgccaccacacccagctatttttgtatttttagtagagacagggtaggaaaaaaaataagccctatcttttaatagaaataataattaattatagcattgttattggttcttttggttattatgatttttcaggggaaagcacagattttaaatgaatttataggttggcagaagagattattctgtgtcccagaaatgccaagcaataaatttaaatagaacttagagtgttttctaaaaactccgcaatgatctgggatcagacgaccacgaggagtgtttgtcatttccaaggtacaggttgcttgaggacaaaaagtttggtctctttcagacacaaagtttgcagtcaattttttgattcaggatgtagatttcatatgtgatttacaattagcaaaacacacacacttctaggcacatggctctctaacgcagaccaaactgagcttgttgaatgagagaggcatgggagagtttgacactggatgttccccttaataaaagagtctgagttagccctggtaagtggagggctggaggagtggggctcctgcctgggagatttgggaaagtaaaaggtgataagggaaagagatggaagaagaacttgaagatgcctgcaaagagccacagatgtacaaatggaggatgtgaatgaaaataaaggaagcagaggaaggtcgagagtcaagagaaagaaggaagagacagaggagcctcgcccgtggcttggtgttctgagggcgcctccctggttgggggtgggaaaatcaaagagcagagccagcctccctgaggctctgcatgcagccctcccggtgcaagcccaatctgcaccttgttccaggacaccctgcggttctctgggcaaatggcacactccccagggagggtctctgctctccgaccgctctgcctgagctccttcagcaagaggcaagagcaggagccagcttttcttttttagagatggagtctcacgctgtcacccaggctggagtgcagcggcattgtctcggctcaccgcaacctctgcctcctgcattcaagtgattctcatgcctcagcttcccgagaagctgggattacaggctcgtgccaccatgcctggctgttttgtatttttagtagagacagggtaggaatgaactttttaaaatattcccacgtggggcacagcaggagcaggccaggtgtctgcctctcaccctatgccaccctccttcctttccacaccaccactgagaactaatcacattgctggccactgagggttgggcttgcattttccaagtgctctaattttgaggtatattcaacagaaaaggcaatactaatgttggctaaagccttaattcctatatatggaaaagagtctcaattactgagctgcttctaggaggaaggtatgtaaaatttcactcctggtttgaccacttgctctgtgacctgaaatgatttactcaaccttgctatgtttcagaatcttcatctgtcaactgtgggaaagaaagcatgccccaccttcttcatgaggttgggcattaaggtgcaaccctctatagtttattaaaattatttgttttccactgctaggttaattcctgaaaatgcttctgagattgcatgacaaatattatgccagggtggttcagcaacttttagaactgtcccttcacttatcctaatatgattttatcacataaaagcattggcatcataagttttgataaattatgttagattttgtggataacaatggaataactgtgcctcctttttaatacatgtgaacatgtgtgtgtgtttatgtgtgatacctctgttctcaatatcttataacattcttgctattttaaaatattcttcttataactagttttgatattgttgtcataattttataatctcatgttcaagatgtacttctgaaaaacacacacacacaattgtactcattgagagagaatgaagagatgaagcagataactttgaaacaaaagagaaataatatcagcaagacatcatcaaagctttcatcataggttttgctttccttaagagccttccatcccagcatcgatattacttatgccaggaaatagaaaatgtagagacctccccaagtctgtgtctttcaggggccactactgcatacccaatggaatctcttcattggtaatgaatttcccttatctgtaatcacatccagaataagacaaaacaatatacaattaaatatcggcctattctctagtttcaaaagaaaaaccgtcggtagctgtggtacacacatctccatcacctcctttcaaacaccctgccgatgtgagccctgaatgacaacccctgagcactggccacggctaatccaaagcaccaacaactaatcacagaattggagaaggcaaaatagctacttgaggagtaaagcttcccagtccttggttctgcaacagcagggtggaaagtgaggggacaggaaaatcaaagttcctttaaaaaaatttatcacacatagaggcaaaatgtccccacagcaggaaagcaagtggaaaatacaccaaatcaatcaccttcaaaataaggcttaaaatcttgtactgcataagatgtaggtgggaagggaagaatgggcccagtggtttgaaaatgttttattaaactgcatgctgactgccacagtgcatacaggaaaatgcaattaaggccaggccattaaaaagacgcccaaggatagctctgagagagaccaggggcaatcagcaggtgtccaggcaatgttcaaaggaaactcactttgaaaaagtgccaggcaggtgctgggagcatctcaaacaggacaggcctgacctgggatctcttgcacctgccttaagaggtgaaagtggcagctctgggcaaggagaggaggtggaggtgtgcgtggaagggcctctcagtgcctttcctcaagctgaactggaacagattctaaccagcattgacgtccttaaggaacatatatgttcaggatgtggtggcatgtcaaatacaaagccactttaccgtcatgaggggcccccagtttcctgagtaaggtgagccttagtgcctctgagatagaggcctcacccagcttctccaccagatcctgtccaggtgatgcctgctgcctagagttgcaggtgtaggcccctggtgtgtagacatgccacctgcttagagggagagaccagaggatactggaacaatcccttaatggacagcttgccttctcctgagaaggtccacaacacacaatgcttatgccaggcagaagttgtcctactcagggccttcccaggaggtgcagtgtgccctgatggtcatgtcatggcaggcctggggcgatccccaccctctccctgccctttagtgcaccctgcagcgccctacttctgcctgcttggttcagggctctctcttctaaatacctgaaggtgtcatatgagctcaggctttcccacttgccaaactcctgggtgtggctctatcacaccacaccgtaactactgcgttacacattacactgtcttcaccaccaaaatgtatccactctgaggatgggaacaaagtctttccctctatatgaacagaaatgtttatccctaaggcacagaactcacatagattagacgctcaaaaatgcttattgaatgcgtctggcatgtaatgagtaatcaataagtatttcatgataaaagaaatgacaatatttggttggagagaactcaaacaaattgattcaggcatatgtgtgggtgaacaaataaactacaactcccatattttacaggcgtgggtaactgcaatgtgtggctgatgctaatgaccaatcctttctcccttggctctaagtaaattcttgatttaggagatgtgaagactctcctcttgtgcttatcccggggttcctaatttttgcttccatcctaccaagccacgcactgatgtttgcagtcccacccacactgctcattgcctttcgttagagatgatgtgctcattgttgtgggtttgctcaggctccgggatatgcatcctgcctcgctctttctcctcccatttcttgctgtggaagtctgtggaatgctggcagggcaactctgccagggtgagcaggttcttctgaggtttctaggtgaaacatcagcaacaaagtacctattgtggctgtagcaagagaagttttatagacttctctaacgttaggaaggggaaaacaatttctgggcctcatgcaatttaggagatgctcacatttgcctcagaaactattgccttgcagtgattttctgcctctagtgagtaaatgctccccaggcctagctactgtcgatgacagccatcccagtgctaccttagcagagctttgctttctagctgtgacttgcttatttataggaaggttatgcttacatcttctttccccactatattactttctaaagttatctgttgtcccctctcttcttttaccagctccttaatccttctccctctaagcaggcaatgctcaacttttgcagcaggaaaggtctctttggaaggcctgagggccagaccaacttgccagtatatttgcatatatttacatttagtcggcctgcaaacatgaggattatgtaaagtgccagtcttaacagtgaaaggattgtgttcggattcaggaactttaggttccatagaacacaaggaggtgggaggggctgcaatgattgctattccagggagaagcataagtgcgatttatgggaatgagtgatggacccaggggttggggctagcttaaatctacaaccatccagcagggctcctgccttgtcctgctcacatgtccccaagtgtcaccttgcacatagttaggtgaagagttgagatgctgcctctcacattttgagagcatgcctctggcaagctgccggaactttcttctcagtaaacctgttttctaggcacctaagcttctctcatttagtaaattctgcacatctctctgctgaaaggagctttcagaccacccgcctgctctttcctcacgtgttaaaagctgtactgggtcctgaccagttttgatttttctaatcaaggtaggtccataggtaatgacatgttgccaacatcttttgaatgcaagggtgtagagctctctttgaagaaaataatcatcacgtggctacaagaaagcagtacggtgagtcaaaagatctagaaaactgctccagtatctgtagtcacccaacaaattcttcctacccgctgcgcagaaaaaaccagttcactgagactatgacaatgcagtagagaaagagtttaattgacgcgaggctggccacagcaaagaactggagatattactcaaatcagtcttcctaaaggcttagaggttaggggttttaaaggatagtttggtgggcaggaggctagggaatgggagtgttggttggttggttgggaatgaaatcataggggtatggaaaacagtcctcatgcactgagtctgcctttgggtggggtcacagggcctgttgaatcacaagcagcagatctggatggagtcagcaatttaaaagtcttaaaagacatctcaaaaggccaatcagaggttccacaatagtgatgttatgtgtaagagtaattggggaagttacatatcttgtgacctccaaaacaacagctggttatcttttaaccacacccatatcttagcagaattcaagcccctgtaataatcctaactttgtggacgttgattagttttacaagtgtggtttagttttgggaaaggctattgtcatccttgctttaaggttaaactataaactaaattctaaatataattctctcttgacataaagccacagaatatgactttttttctgttaccagctatagtgatttctattatagctattaaatacaggggtctgaacaccagagttacaagatctatattaatatattaattacatcaagctggatatgtatacatcatatatatatatagtctgtatatatgctctctctctctctgtatatatatatatatatatatatagtctgtatatatgctctttagctttctgaagaaaagtgattgcagttgacatctaatactatgcttctccacgtagtgcctcttaaagaaaacaaatgcagaagttcatgttttccatgccactcttccctttagaatatgatattagttcctaagtccttctccaacttcattgcccatgaggtgggtaggacagaagtggctgctccaataaggaaagctttcccaatcttccaatgcagattagaagtctcccaaaggcagagactatcctgagcaggacatggaagagcaggtgacctctgggtcccagaagagcctggctctgaacacaggcacgtgatcaatcagtgtgaatgaatctagacacaagaaagttccatatggacaatgtctatgtgtcctgagcactgccaggttctaatacctgcctggaacatattagtcacttaattaatgcctgagggaataggaggaagtaaatatataaactaatatttaagaactttaatattcaaagtagaacttagatacataatcaaaagtccaagcaaagaccaaagtctaggatgccagtctagaagtactaggaagccaaaaaaataaaattcagcatcaaagatagctggcagcaaatgtcaggggcacaaacctgctgaacaagggaaacttagactatgggctaaattattttgaagctgtggctcaagagtagtaactgtggccactgaaagatggaggtttccaagccttcaacagcctcaacagcaggctcagagaaaggctagcgtacgattccaggtctgtcccctactttgggagaaccaggcttaaaatgtgggggtggtctggtctcagtgatgaagcttaagaaggtccgatctgccaggattggaaaaaaacggtggaaatagggagaaatcatcagtaagggactgttgtgtaacatcttgtggactgatattttcacccagaaagagtcgccagaaaaattcagcttcaaattcagttaaaaaaaaaaaaatctaattccttttctaggtttaacaactacagaagtaaaaaatatataaataggtagtatgcgcctgacctagtcatctatcttggtgattaaatgcttggctagttgatggcgtgtcaatgaagtcaggattacataaatgatattcaaacagtctcgccaacaaagcagctagtaatgcagatacatttttctactaacgtattagaacctttgaaatttgtttctttttttctctttttttagattgcaaatctggatcttctttaagttcaagagaagggaaaaatatttatgaagcttattagtgagcagacagtactttacctgataaatataaactatccccgagcctcccagtgtcttctttagcatctcccaggggaacagagcagggtttttacacattaaaataaatcttcagtgctttatcaccataggtcctgaaggggttgaatgaagtgtcaagaaaattattcagagatttttcctctccactcacagttctgtagccttaatttagtgtatcctcacattcgctatttcttttccgagaaaagccagaataaatgcaagtcaggaggcattatatggaaggcttattcgcttggacatatgatcactgtggtgcaatggatccacttccctatgccagcatgtattccaagaggaggctgaaactgccttatattctaggccctgtgttttgactgaattagttaaataaagtgcaaagctacatgagctggatgaactaggccctttcttctacctaaaataacagaattatgtgacaaatgtatgcacagtggtatgtttaccttgaagcacccagataattgcttgaattctgcacgtgactttactaatacataactattcattgcaaagtttcagaggcgcttgtttaaatctggattttagggaaataacaattttctaaagcatcattcatccacagataatttagaacaattttattaaaaaaataataaaagcacttacatcgaccctaaaaatctgaatacagcaagcaggtaactgggtgcgcaaaacactcatttgcatacacaatcaggcatttatggaagcacatgcccaattgtgcatgtaaagacgggtttcatttgcactttattgcttcaaacaatggacatcttgtatccgggggggagtattttcaacatgtagctatctaaatttactatttcagctttcttttccttaaacatgaatgtagcctgaaagctgcttcctgaagttcaacctcctgccgcttggttctgtttggggagattctaagtgatgacttatgatcatgattaccttgcaaacgtcttttgtcttccaagggcagtggggtggagtgaatagaagaaatcttaagagttttaagaaagtgctgcttgttgacagcaaagattatcttgtttgataaaatcaattttgatgacagcacaatctgagatcttccttgaagttgattttatcgagataatagattaagtatgtctgtcagctagagtttggtcaacaaatttttttttggtcaaatttctctggtaggcaagacatatatcatgaagtctggctttttttttttttttccttgaataaaactccatttcagaaaggaaaaaacatgggaaggtagactggggaaaaaaatgagtctccttcttttctaaatcatatgctttgatgaggacctttcatataagccatcgatcattcctgagccttaacaacatttgactaaagtttttgtttttgttattgttttctttcaagaacaaggaatgggaggaatcgaattggaaataatttaagtgttctttaggacttcttaaaaatataccaatttttattttgcaatgggggggattgtattatattttaaaagtaagcatactccatagttttagacagggaaatttagatttccacaatttttgcagatttttaaggggagaaagacctctaaataattggccatcataaatctatacccaaaagttgttccagaagaactactccacactgtaataatcatgggcagtgttaccgtctcacagttaaaaatgatattggatttccaaacacaattgcacaaatcttaaaactactaaaatctccaagaaaatcttcctcttggagcatgagctcctctgcagctggtcttacaacatagtaagagggcattatattcttatctcgcatgcaaggctgagttagaatcttgtgttctagtcctgagtgtatcggcccagttaatcctccctaacaagttgggtgatagtggaaaaaatgtgacttcactctgggatctactgaagttcaatttcctgccacttgattctaagtgataacttatggtcatgaatgccttacaaccttcttttggcttccaagggcagtagggtggagtggacagaaaaaatgttaaaaattttaagaaagtgctgatttctcatctctaaagtctcttcctgcttcctcatctcttcctgcgaggacaccccatctttagagatgaggaagcagcactacataatccccaaggtgcagatctaatcatctgttgagctgtccactgtatgacccttcccttgaagcatgtaactactgaggcatgggctcaggcaggatagaatatttacatttcagtccccctttgccttattttattttggattgggaatgagaactcaaaagtatattcagttattagggactgtcatatgtagtccaacctgcagaaattttccacatgtgcagatgttccttgtggaaattttaggtgtaatcatggcagacattgttgcttacatactcaatagctatttccaccatccataacactaacaacctgcttcctttatgagagaagccactttcctctaaagaagctcgaataccataaactcattttctgagacaccctggaagccaggctgggcatagccaggccatcaaatcttaattagtaggatccagggggaagtccgagggcagctatctggagcagctttccttccttaacaaaaggtgacatgcaagaaaaatcccctttccctttttgcttctgctaaatactgctgtgtctgtatgcttgcctgcaactgctacccccatcttttgactgtgatggtccaagccacacactggagaagaaagacaggaagaacctgggccttgaggctctcactgtagccctgacttccacccccagcctcccacccccgatttcttacatgaggtaataaacgtctttcttgttgaaaccctttttagttggtgttggaaggaaacattattgatgcctcttttacccaaaagaaactctaccaagtaacactctgtgcctttcctggcaccctcccttactttccctcctgctgtccccaccccacacccatacacaccccttaccaccagggagaagagatggctcaatctgatcaggtttgtggaaggataaatcaggaggtatcagctctttattttgtcttagaaactgaccttccaacagatgtcctgtgtcatgcagcgtaagaggccaggctcagacccagggcctggggcctcctcgcacttcctgtgactgggggagtggggtcgaatcctgaggctcaggattgggatgcccatttgcttacgtaaagatataaaccacattcccggcttttaatttctatcagaaatgaagggctatttttatttccatctattttctccctgtttgtctctcaagttgttctgaacttaggcagggaaaagagagctaccagcacctgtagtcccagctactcgggaggctgaggcaggagaatcacttgaacccaggaggtagaggttgcagtgagccgagatcacaccactgaactccagcttgggcgacagagcgagactctgtctcagaaaaaaagagagagagctaccgattgtccccctcaaacaccaacagttgggtgctctgttactggcagcagaagacactttgctgtgttgttggtgcagattttcgattagcctaggaccacctttataggcaggacagactgcacttcctcatgctccaccgtcacccagctcagtccacttgtaattctggttgctgagagctgactcacttgtcatgaggcactcagggaataaattcgtcatcctggatggttttttttttttttttcaatatggtgagaacatcattagttaggtattcggtagatgtacgagaaaggctgaatagtcatgtttctttatcatctctgatgatgaaactcctccctgcccatctgaacagttggaaggagtccagagtggagcagcagccgtgctgaacgcagagatgtggagatggccacatttgcatagtttggctatgtgacaactgaaaggcggatatgacagaatagatacatatctcacataccaaagagagagtgattacctcgccttgctgaagatagggaagcagaaaaagaccaaaaggagtagatataccgggctggctatcatggaaccactcaggaagcgactcctctgcggcgacattgtgttgcgtggagataggatgatatcctgagaatcatagagccactggagagagacagacatcacttgaagtccctgctccattacttaaaagatatctgaccttacaaaaatcagttcatctttctgaatatcagtgttctcatttttcacatggaaatagtgtcacctcctcttctcgtgtcacagagttgtgaaggtgtaatgagttaaggaacgaatgcaaaggaaccttttaaatcataatattatttaaatgtcagctgcttgctttgacgacagttccacaactgtgtgatctcctccttgctccctccaaaaaaaaaaaaaaaaaaaaaaaatgtgtttgaataaagatgcctgaggcaccctcaggggcctaacaagatcctgcccaaatctccatgtggcacaatcatgttctcattctttctttttttttttttttaagctggatctgcattccctatcctagggatgtttacaggagggactctttcaggcagaaaccattttaacagcccagccctgatcagcatggctgccacattttcatttccagctacgtgtttcgttacccagctgaaaacctggacaaaacttataattcagtggccttctgtgaataggtccttagggtctcacagatgtcctggatgttaacacacattcacacacacaaagaatttattgatttgacttgtgatcttaataaatactccatgatacgtcttgccatgctgaaggattttgtagacactacctgtcttgtgcttttaaatctatttcctaatattgttaatctattgactttttaataatattttgatcatagggtaagttttcaaaaacgtaaacagagttaaatgtgaatatatttttcttgttaaactagtttttaggtttcttgtcgtggtttaaaaatatatgtctctactaaaaataaaaaaaaaaaattagccgggcgtggtggcgggcgcctgtagtcccagctactcgggaggctgaggcaggcgaatggcgtgaacccgggaggcggagcttgcagtgagccgagatcttgccactgcactccagcctgggggacagagccagactccgtctcaaaaaaataaagaaatatatatatacatatgtatgtatatatatatttcctaaaacctagggagattatatatatcttttatgtatatttacacctaggagatatatatatatatatatatatatgtatatatggttatttttttcttttaacatttaagtatttattattttactgagataaaatttgcaactacagatcttaagtgttcaatttgatgagtttgaaaagtttatatactcaataactgccttcaaaaacaaagaattttttttaaaaagttctctcataactttccttcagtagtagccactggaggaaaattatgagagaacttaaggaaatattacgtatctccctaggtttgagaaaatgtactcttttgatatctatcaccataaatttgttttgcctaattttgagtttcttatgtatgattttatacagtatatatctattgcatttagcttctttcatttatcatgcttctgaatttttcttctgtcttttatgtagacatagttcatttgtttttatgtatttgctgagtagtattttattatatgaatatattacaatttgtttatccattccccagttggaatgtatatttgagttgtttccaggtttttgtaaaaatgaatgaatctgttataaatgttgttgtgccaatctttttgtggacatcgttcctatttcttatactaaggagtataattgccgaatcatggtagagatagatggtgaagtttataagaaactatcaagcatttttacaatcattgtacatttttatactcccacttgcaatgtatgagaatcacgattgctctgcatcatcaccaacacttggtgttgccagtctttttactattaattattctagtatgtagtggtatatgctctctgctctcaactatgagaagacacacacacacacacacacacacatattgtgtcctattctttcaacttatcaatttaacaaatacattctctcatattaccaaatgttctttgaagtacagttttaatggggttacaggcacgtgccaccacgcccagctaatttttgtatttttagtagagacagagtttcaccatattggccaggatggtctcaatctcttgacctcgtgaccgccccacctcagcctcccaaagtgctgggattacaggtgtgagccacggtgcccagtcctaccatttcttcactactccaaatagcttttccttattgtcataaataacagtgtgatgaacatcttcatacattgacatttgatgtttgttattctttagtaagaattaattggtgtataatcactgccttaagggataagaacattttaaagggctgagatacatattgtggattgctttgtaaaataacgtatacctcaccaacaattgttaacagtgcccttgttaaccacaactttctcactattgttttaatttttttaaacgccagtatagtcattgaaaaatgaccttttaatgtacaattcgttcatactaagtggattagattattttatgaacatacttaggttaacaatttttacatctagatttcaaaatatctattcttgtttctttttaacttattagtgccttttattttctttatatccattattatggccaacttacagaataatgttaattatctgcttgacatgtttctagttaatatgttttccagttttctttatctgcttggttttaagtagaacaaccttccacaaaccaaagatgacagagtatcataaactaaagaatatgatgaactcaacgctgcacctggggccaagtaggaaaaaaacaaaataaagcaaaaaatcatttttagatgtttctgacattttaaaagaggatattattggcataataaaagacagtggttatgtaacagtattttggtactaacttctgaaagtttcttgagttacccctattttcatatgcaatgaggacatcattaatccagataaaacctcactgaagattatatgtaaattagccgatcatagctaaggtcatgtctgtgtggtccaagtagaaactaaagacaataattttgttgcatataattctcatttatcttctgatcagctagactgcataagcaagccaagcattatctactgtactcagtaagttgttttaatcagacacctgggatttgctttaattagatatggtaggacatgcagacatggagatgactgtcacgaggaagaagttcattatattcacagattcttggaaacaggggcacagcgtatgacgcaggaccaagcagggaagcaccaggttgggctgggaagcagaagaagtgagaggaaagtgttactgtgctttccatgggaaggaaagagcagggcagggcaagcaggcttaggatgggttggcctgaataatttcagtgggctctggggtgaaagtgaaggtgtgtagtaatccattctcatcctgctaataaagacacacccaagactgggtaatttataaaggaaagaggtttaattcagcatggttgggaaggcttcaggaaacttaacaattgtggcggaaggggaagtaaacacatccttcttcacatggcagcagcaagaagtgccaagcaaagacggaaaagctgcttataaaaccagcagatctcgtgacaagtcactcactatcatgagaacagcatgagggtaactgccccccctcattcaattacctcccactgggtccctcccacgacacgtggggattatgagaactacaattcaagatgagatttggctggggacacaggtggtgtaagggtgtaattatctggtacctggccctagggtaatcagggcaggcgatagtggcccagagtgggagagcctgaggaaggagatgattgaagctgtggcctctagattggttcctttgcatatagaaggttaattcacttacaggtgagtcctttcctatttctgaaaattgactaatcctgggaggggtagtgcttccaaggtcagcaagaccccagatgccaaagcatcagaataaagaaaataaagacaggaatcacacacatgtcaacagaaacaattctcaaattttttttgttgccagtaaaatttgaaaaatgcttttttcatacagtttccaaacattacaattatacttttcttctaacctctttatccaaaccttcttcaattcactcatttttcccttggtaacgtgagccgtgtggctctggctctctccttctctgttcatggctctcttccatcccctcattacttacgccaaggtaacaccatgccctcccatctcaccttcctggctcctgtcttctgtcctctctcagcaattctgcatacctagggcagtctaatctttaaacactgctttttcttacctgcttgcaaatctgtaaatatccccttatttttttatttcatgtcaaatcaaaaaaatttcagcctagatttaaatatgctttctctacattccctttttcttcactactatcacctttccaaatattacacattatacgaggcccagttcaagctccacctccacttcaaaacactaccttagtcttaccaaactcttcttcccaaagttatggaaatgagcttcgattgaatttgctttattattgtctattgtaaatgcatcagctttccctttaacttggatgctccctgagggcaaatctgttattttcacttactactaggctagtacagaacttaatcactattgccattttgcatgctgttctctccacagagaatgttgcttcatgacttatctagctgaaatcatctacatgtcgatcatctgaaactcagctcattaaagactccatgaccactccagacagttcacttcctcctccacaaattcatgatgttttgttagaacacaactgcatctcagcatttgatcataataatttacttctctgtctccaccaccatagtgtaaactgtgcaagtgcagaggccatacctacatgtcattgcatctctatatcctgatagattgtgctatatatagaaaatgctcaatatatctaaagcattaatacttaacattaggaattatggctaaaacacccaccctcaatattcctgatgtaaagatggctgcaatatttgggttgaactgttcttttttctattttaaagaggatgtttgacatttcacctacaggttagtgaatgtaataaattcatttgtgatgttggagttattagataattcatatcactttcataatgattctttcaatatatacatagtttttctggccattatatatcttatatctcctcttcctaagttttgtaagcaattcagtaatcatttccctctcgtttgctactaaaatactctcctaattgcaatagatatagaatggatctgcttatttatctttctagatttatacttcattctctatttatagctttttagtgttggcaggtgtgatgtgtttcatcatttgaatatatcaggaaaaatgattttttaaagctatatatataaagctttatatatgttttatatatataaaacatatatgtatatgtatgtgtgtgtctatatatatagacacacagaaagagagagagagagagagagagagagagagagagaaacttccctttaaaaccgttctgtacagcagagatattttcagaaaagaacaaatttgaaagtgtataatccaaaactcagggcagcttgattagtaaatgcatgttttttttttttaaaggctcataccaaataacaatgaagcagtttgttctaatcctaaagccactcctacaaagattgctttgagccatgtcacgaggcccttactggagaaaaattcattcatatagataagctaagttttcatttttataagccttttccctatcttctatacaccttatctgaattcataacatacatatatttttaacatcaaaatctagtcatattaatcttatttctttcccaacttaaaatccttctgtggtttccaaattccctatctttgcatttattcctcatagtatcttactttttcttttttgtccagctttatcttccccctatgccccagcctctacagctccttggagtgccttgaataggctgagagttgctcaggtccatgcctgcaacacctgtactcccttgtcaggtggtactcccgatcatctttcagaatctgtttagtgtcagtccttctgtaaaatgttccagccatgccccagaaggagtgaccatttcctcctctaagccccattttaccctgttcatgcatctagtatagtgcctgagatgctttatctattaacgtccttacttgttttatttataccaaatgctgcaagctccttgaggaaagggactacatatggcctggtgcctaccttgtaggaggagttcaatgaatgtttcttgaaaaaataaatggagacatgtatttaaacatatgattcaaacaatataacaagtgctacaatagagatgtggccaatatgcatggagaagacagcctatagttccaacagttctattagaggcatttcaaaatggctagcatcagtcaggactcccaggacccattacaattaggaatttgaaagatatttgcatgtatggctgttcttcctcacatcacatatacctgttgagaggtcactgatgccagacaccatgctagatgctgggtatgcagaaataagagacatcatgtctgttttcaaacagctcatggtctggttttggagacagaaatacaagcagacacacaactcctacaacattggtgtatgtgtgtgacgtgttagcacataggaaagcaccttatttcagtttcacatttaggaaatgtgaatctcttctttcctgaagagatgccctctaatctgcattctgaggggatgaacagagctgtttctggcagaggcataagtaactgcctcggctcagagatgctggagattatggtggtgacttagaggctgtataacatggcggatattagtgctgacagagggaggaagaaacatctgaggtgacaggagtcaacaagccccactcagatcatggactgcttctaaaatatacacctcttcacaacacccctctctgaagaaacctactacattggtgctccttttctggtccctgttcatgtaacttaacctgatctgcaaaaatcagcaagatggtgttgtagggtgcagagtggagggaggtgaggcaggagaaaaaaacaaaaaacaatgaacagacaggaggcacttgagagaatccaggtaagaagtgacaggaccttgtataacaatgttgattttgaacataaataaaagtattccatccattcaaaataatagaaaagtaggtttaaacatattattttggggggaacaagagagagggaagtgttgaagttgggtcttttgttttaggttttggcaactggctgggggtacagttgccagaaaaaatacaggatacccagttaaatttgaataaaaaatgatttgatgctgatctgaaattccaatttaactggatgtcctgttgctgtgcttgctaaatctagcaaccctaataacgtggcatgtttgataatagaaaaaagaaaagaaagagcaggagtgagtatgaggatttgtttcggacacgtaaagcatgaggtaacctgcaggaactgagatgtttgtgcctcccggaagataaggatttagctgctgaagagactgtggagttacgactagaaactatgatcaatgagaccaacatggaggaatgggtagaacgagtggagttatgactggaaacttggatcagtgagatcaacatggtgtagtgggtagagcaagcagagaagggctgtgatgtaatcattggagcccagtgatctgaggttacatagaggacaagggacccctggaagagaatggaaggagtcggtagaggcatacagagagtatgaggtgcgtgatatcacagaaataagaaaagagtatttctacaagaaaaaagtggccaacggcttcaaaatctattgagaaatgtgaaaggaaacaaagccagctatgtggatgttaatgataaccttgttatcataccatgatagtgatatgagcagtttcagtaagggtgtggtgggaagccaactatacaaacttgttctacctcttcagttctcataaacacttgagcctgtttgctgaatgcatttgcctacagttgcctttatttaaaccataaggttattatttccatgagaggatagctttattaatcaatatatgaatccctacaaataaatgttgaagaatagttggaacactaaattgcaaatatttattgagtccttattatgatctcaccaaaacattagatgttgcagatacacttagcagtgctgaaacaactctcagcttcacagactcaagaatctgaagtgggagcaccaacatatgttaaattgaaaagagcaatccatccaacacgactaatggtcatcaaatatcaagtgtgtagtgtacgtataagcccccaaatttctcttgtttctagtaatgaaaacttgtgacagttctttcagtgaaagtggagactattctttaatattattttttaagcaaaagagtaagcatagaaaagcaatgtatttttactgtcatcatcttaatgtatttcaaccagtcacagctgtccaaattgaccctgtgccaggggcatcagacctaggcatgctaggggaagtagcagccttgggccatgcctgcccacccacacattttcaggatatgtcggatgatatatgatacccagcccttccagattttctcgttaaaacagtgtatataataaaatgaaaataacgatgttatacctactgtgtaaccacctgtcagtaaatttatgaacaattagaaaatggaagtactttccagggagcaatttgtagaagcaataaaatgctcatttttttcagagatataataggacaacaacttttctcttttttttcccccaaaacagcttttgcagtcattaatcagctctgtttttttgttgttgtttttaacgtcccagttcttcaaaacacactagataggtgcaactgtgggcgatgaaggagccatttaaaatttccaggcgaagtgaagctcagagccaaggctgtttcatatttgataggtagtcacacttcttaataaacttgggtttatgtgctctgcctcaggggttttaccgctcagaaacagatgccagcattttcgtttgtggagcaaacattaacccaagacatccattcagaatgtgtgtgtttttcccctttgaccttattagcaaatgacctgaggcttccaacatcctccaaatagcccaaactgataataaaattactaaaatttataaggtactttctgttggatgaaattctttcttccgcattatctcgtttaaatgaccgccatttagagttgaggaagttgagggtcaaagagatacgatgagttgcctgaggctgtacagtaagtagagaactaaatatcaaacccaggtttctgattccaaattcttttcctgtccactgcatggagatgcttccccaatactagtgcaatatgataaatgcttgcaaccaggatcaacacaagacaagggcactacagcctccaaagcgcaatgtggtaccttggagagatggggaactctcttagcagccccccatggttccatcctagggccatgggatctgagaagcactgccattgtctcctggtcctgagagttctcctccactgaggtcctggctggactggacttccagggctggccagctgaagccagcagaacagatgaagaggcctcctgacccacatcaggctcgactcccactggcgtgaaaacgtcaatttcctagcacagccatgtttttccaagagcagttggttagtccctctctctctgccatttcacctcttccttttaatcttttccatttttatttctcatctcaagtcctttttttgtgctcttggcttcttcagtggcctttatacaggtttccacgcttctctctcctcttttcatgtttgctcttttgtaagaggccccctttcttcagttgtctttgttgtttgactcctctttttaggatgcctttcccctctattcattgttattctccctgagatttttctcttgtcacttgacggacttgaattttgatctttactgccggactaaagctttgtcaaccttctgttttctttgtgagtcaactttttttttttattattctcatcattcttcttggaacagaaagcaaatattttttagcagtctgtgtgattcatttggtgccttattttggcctaaatgtttgttctctcttttataatcaattattttaattgtagctgtctgggctctaaaggtagaaagagatgatggctaatctctatttcaataattggaaaccagttcttttcttgtagtgtctacaaattccatggagggaaaatgtattccatgtctcctacacaaaagattttagtggacacatccaaaagctatgggtttttgtgctcttatccatatgttttcatggcaaacttactccataaaacctcaggaagagagcagtttggagtgtgtgtgtgtaactgaggcatagctacatgcaaaaaaggacagagatcttatatgtacagcaaggagaacttatatatgtgtaatcacctgtacaaacactatgcagatcaacatataacacattgcattgttccagaagctctaatcacgccctttcccatttaatccctccccaaacatcatcactagtgtgcctctcctcagcttcatataaatggattcatctaggaggtactcatttgtgtgcagcttccttcactcaacataatatctgtgatatccttccatgctgtgtgtgttttaatagttcattttttaattgctgagtagctttccatttacagattccataatctatttgttcattctcttatgataaacactggttggtttttatcttttagccattttgaataaaattgctctgaacatttttattcatgtcctttgaatgtacaactactaatttttattgggaaaatacctagaagttgaatttgggggcataaagtgatgcatgttcagatttaatagaaattaccagacagttttctaacacagttgagccaactccctgcagcaatatttgaacgtttcacttaagatgcatcctcagcaagacagtattattagccttttaaaattgtagccatctggtagctatgagaggaggttagaatttacaagctaaccacattaaatgcaccaatccttcaaaagccttgtgtgtcacacgtgtcctacatgggtcctcagattctgttggcttccttgactctcaaacctttgtttgcttgctcagatacctctgccattgtagctggcatgaccttgcagttccaccttttgaagctgaccagctgagcctccaaaatctctggctcctctgctgcacccaacctcagatgaaatgtgattcttcagggcatgggatctggcttctctagtgattgctgcaggggccatggatggcaatctagacatccaaggtgttcactccctgtgaagcaaacttacaccaaaggaagacaggacatgagatgagagagagccaggtcaacgcattctctatctgttctttctgagaaccaatgattccaaggcatacactctctctagggtccctttgtagacatcctgcatggctgagcagaaacacctgccaagtcaccagctgtttctctcccctgttcattgttgctatgtagccagtgttggtaaagcgtcaccttgggttgcttcctgtttttcccttcctgattccccttagccttccatctctctgccatgtgatttcaccacaaaaataaggcattggcatttaatcacttcctcagggtctgttttctagggacacagcagtaagatagtttggagaaaaattccttaacatattaactaggcttgatcaatattaccaatccatccaatttctcaagagctgaaatgtgagtgtgtaactgggatattggactgagaaagaaacaacttatctgagggtttgaatgaccaagttctagtcttgtgttttatgtctgtgagtttcaatgcattagtatatggctctgacttggattcattctttgtgaaagctttcaaggatgcagtagaaatgtcatagttactcttttaagagaacctcaatatcaaatataatctcatgtgaaattgcttacacagtggttactattcaacagtattgatttttcttctcctttccttcaaagaaaggcatgctctaaaattaagaaaatctcttatttttccatagagaaaattaagagaaaatttcactgagttttttaaggtgacatgctaaatagatttaatgtcaaatgaataataataaaatagcaaattaattaattatgctgtttcattcactagggaatattttcccattgttttaggccaattttttttttttttttttgacatggagtctggctctgtcacccagattggagtgcagtagcgagatctccgctcgctgcaagctccgcctcccgggttcatgccattctcctgcctcagcctctcgagtagctgggactacaggcgcccgccaccacgcccggctaatttttttttttttttttttggtattttcagtagagacggggtttcaccatgttagccaggatggtcttgatctctgacctcgtgatccgtctgcctcggcctcccaaagtgctgggattacaggcatgagccaccgcacccggccgttttaggccaattttaccaatgctttcatgctcctttattccaagccgttttctgtgtaactctgatttcaacctttgctgatgccactagcattcagctgttcattcataatttattcatcaaatgcctaccatacactaggcactgtgtttggtactagaaataaaatagtgaacataaacagtgcagtctctgcctttgtgaaatctgaggtccaataggaagagagattctattacagaattaggaagatatatgtagtaatgcaatacatattctgaaagaaatggggagtgctatgagactccataatgggcaggcccggcctacttgggaagttgtgagatggctttgctgaggaagcgacagagcttgaggaacgtgaagctctgaaggaccattttggctggctggagtaccgaacctggaggggaggtgtttttagatcaggttaaagagatagctatggtgagagctccagagggtgccagtcatcgcaggagcttccatgctttccctcgaaaccatagggaaacatttgaaattctaaacacggtgtgtgtgtgtgtgtgtgtgtgtgtgtgtgtgtgtgtgtgtgtgtatgcgtgtgcttgtgtgtgtacaatgattaaatgattagactttttaggagattattctggctgcaggggcaattggacttggtcaagagcaggttacaaggagtgggggaggaatgaatggaaacttattgtttaagaagtgcattaaatgaggttggaatgatgggaaagttctggagacatagagtggtgatgcttgcacaatattttaaatgtaattaatgccacaaaactgtacactttaaaatggttaaaatagcaaattttatattatgtatattttactaaaataaaatcaattacaagatctatgtggataaagaagttggtaggtttttgtggtaaatccgttcagtgtgaacaatctagttcacaatgatattctgaactagattgttgggtagtgaaggtgaaaagaagtgggtagatttgagaagtatttttgttttttgagacagagtcttgctctgtcacccaggctggagtgcaatggtgccatctcggctcactgcaacctacgcctcccgggttcaagtgagtctccttccagagcctcctgagtagctgagattagaggtgcaccaccacatctggctaatttttgtatttttagtacagatggggtttcaccatgttggccagtatttttgaagaatgttgaaaagaatttggtatgacagacaagctagctattcaccaaacaaaaataaatagctccctccaaactaaaaaaccagcctttaattacactcactccttaccgttgtgttcattctgtctgctagatatctgtgaccaaagttggtgctgtcatcatgctttgaaggtggcagcacttccatcaacttttattcctgaataactgcatataacctagctcttcgccccctcccacatccccaacaactggaatataggaacaagcagtagagttgtattaagccactgtaacactgcggctgtaagaagctggagttatcttacttggtacctgttatagactgaattaggttcacccaaaattcatacattgaagccataatccccactttgattattttgggagacagggtctttgaagaggtaatgagagttaaatgggttcataaggttagggcctcaatctgacggaactggtgtccttatgagaagaggaatgatgtcagtgatctttatgtgtgtaagcacagagaaaaggccatgtgaagacacagcaagatggcactgtctacaagagaaggagagagttctcaccagatgccaaccttgatgccaacttcatctcagatcccagcccccagggctacaagaaaataaatttctgttgttcaaggcactcagcctgtggtattttgttctggcagcctgagaagactgagacagtatcattggctacagaaagtgaagtcaatgtctatgactggtgatgattaaggcttgtggatctaagtgcatggaggggccaatcactgggagagggacactagacataggccaggtttgagttccattctgcacatgttgacttcgaagtgtccctcagacattcaacagaaaatgtcaattcagtctacgtggagagtaaatagactctccctggccctattattgtgtagtttaactcttgctcagttgaaagaatttcctcgaattgttttgtgaatatatgttctgtctctcctccaaaataaatacttccttggatttttctcaaccccctccccaatagtttctaacatatcataaatacaattgacattcaagaaagcaataggtcattttattgatttcttaagaagtggtggtttggtatccagaagatatagaaagattcagagtatcttagaatgtttcgagtaggactagactacttcagccattgatctgctgcaacatatacttctgcaacatatacttctaatgaaagaaaagaaaacttcataaatatggctactgtctcctttgtcaatgtctctgctcaccattaaaaatattaaaatgagggcaaaagaattaaagtgggattcaatttgattccattgagcaaacatccacattgcacatcttaggtgctcaggttgacacaaccagtgtgtcctccaagtgcttaaaatatagtctgaggggtgtggaaataatcctacaaaagacacatagtgatgatttacattattttatcttctgtgtgtagcaaagtgcctaattcagagatggtgctcaacaaattctccttgaatatgctttcacataggaggtattaatgtatatttggtgaatgaacaaatgaaacaattgatagactatgatataaaaccgtctgtgaaaaaattttgagaagtgttacaaaatgtatactcccaggaataaaaatctagaacattagagcagaaatggatttcagagaccatcttcttctactcccttattttatgcattaagaaacagatcctagaaggttaatacatatccctaagttagcacaggtaatagatatgaaactgcctttgcaaaattatgacagtaagagaaatctgaagtatctgactccatcttgcttctaacatccaagatgtcctttatcattactggaggtgaaccaaactaactttgggaagaatttaatagtgccagctatacattttactaacagtgtgtgcattagtttaaccggtatgcgtgtgtgtaaaaatcttgtaaactgtataacaagtaggtgagcttccttttactactcaaggtcttctgttacaaaaaatagttcatatctcattttaaaacacactgaaagccatgtctccaaagatgaaggtagaattagatggtaagtacaaaaaaagtttttattgagcataggtagaattattctaggttgaccaacgccccagaaaaaaatatcctgaggtatctttttttgcccaaataggtgttgggaaaaccaggtagtcataaacagacctgcttcttcaagtgtagcctagattcattggctctccgtcctttcactttacttttatgcatctcgcaattgtggctttggccctggccaatctgcctttttttccctcttggttactcaccttctgtttgttcctaaaacatatactttgcctatgattcttcttctctacaggttcttttcctgaaactaataatagcttacattcattgagttcctgctatgagctttactaagtagttcgcatgtattacggtcatttctcggtatcaatgcagcactggatccaggaccccaacagacaccaaaatcagcagatgctcaaataccttatataaaatggcatagcacttgcatttaatctatgaacttcctctcatataaatcacttctagattacttataatacctaataaatgtaaatgctacatagatagttgttatgctgtagttttatatttttgctatttatattgttatatggttatttttattgctgtatttctgtggttggttaaatctgtggacatggaactcgctgataaagagagccaactctacttcattcaaccctcaccttgatgccttgaggaaaataccattattaatcctatgccgtggatgaaaaccaaggcttagagacaagaagcagttttcccaagattccactactaatgaatggcagagcaaaaacttctgcaagttttgacagaccttataacttgcaccctttcccctatactgtaataattcactcggagaccacaaatatccatttcctgtattattggcaataaccagtagtcctcttactcttttaaaattgttatttttgagctatctcctctgctctatcccatgttgtaagcacatctttgaaaaaattaataaataaaaacgcaagctccttgaagctcaaagactgtttttctcatttttaatcctttgtagagtataggtagaataaaatacatgtgcattatttatatgttcaataaatgtgtcacattttaatttgacttgaacactccagctaatcagctgactggcaataaaaactgtcaggcagtacagtggcaaaagttagaaagtgcttgttaaaataatcaggtttaaaacagtcagtgacaaaaacgtaaatctcagtatgttattggactttccagcttatgaaaatacacaaattgtttctatatgtctgaattctcttagatacaacctcttttaagaacaccaaattttatttgggaaatgcctatcccatcatcaatgccattctgaagattttacctgtgaatatagattgaatttgagagaaagatttgtttttctctcctcatttcaactagagagaattaacatgtgttaggcattcccctatgttttcaagattctacatttcgggtagaccttgtcctacataagcagctcattcgtggggagagaagggactgtgatgaagaaagtaagacagacacacaagcggtataacatgaagacacgtcagtgcagaggcccgcagagggacggaagaggaaggtgtcactgccactcactgctatggagcctcaagcaaggcctattttctcaggcttcagtctcaaaggttattaaacgaagagttggctagaggtcactcagaattctttgaatttaaaaacggtatgattttcatggtgacagggcttcatcaaggaggtgaaattcaggctcaggaaaatctgatgggggaagcagggagaagatgggtgttccaggaaagggaaaaacagaccaaatccagcaggtaccaaagcacagggcatgtctgggcagcacaagcagcggattgaaccggaaccgggagtcttttgaagaaggcagtaggcctaaggcatgggaaagttggttggggtcatattctggacagcttgaatgcctttttctacttgggcatggttatggaatacaatctctacttttatcccatctatttatttagttaacatagattgactttgttgactggtcatctgattactacacggaaaatatgtgtttggtaacatacttcatgtctaaaaataagcacttgagaactcaacaaatatagcagtgcatccccagaagaggtttcaaaagacgactcttttgttcattccatgcaagcatacccacatataatgtgctcctagaaatttcaccagcaaccataattttgcttcccagatttcttctttctccagccattctgcatgccttgataatactatttctacttttctcaagtaaaaaaatatgtctgttctctaaattcagtgcaaggtgttatatgctgcccctctccattctgctaaaaggccattatattatttcatctttcagcatttgtagttacccctaagattagtcatacaaggaatggggaagaacgactgggattccaatatctatttcctcggttttctttgaagtgtttcttgggacagttccaatggtttggcagagaagaatcccacggaattctcctaaaggtgaatgcttaggtatataaaatcaattagctggctttgttttgttccgtatgcatgttttgagtttatgcagttcttgcaacagactgaaaatatagctgtctttgaggttttcttgaattgatttaaagttcagtgaggatgtcccgatttagattcctgaacaatgagctcctccttttgtaaaagggcatgtatcctgttgtacaccggcaaaggtttacccaagacgtagcttttttgttagagagaacaggattacaatgctctgtgcttttctccaggatagtggccatcggcctagtcttaggaggctctccaggaggcctggatgagcagaaagggtgacatccccgccagcagctcatctcatgacacttcctctgcaagatgaagagattatttttctccagtttcttttcatctgttctgcccctatctaattttaaatcacagtttagggaatgtgacatcgtccaggaataagtttctaaatgcattgcttagtcacagatttcctctaaccatcctctgattggctgtctagaatgaattgaggctgtgccttgaatctgatgagaagccacttatggagcatttatggctctctggggcagaatttcccacaaacagaatagcagaaaataggtgaccggactgcagagcccaaccatctaccaaggcttcactaggcttgctagtgcacgtttgctctggctgtgagtgaggcacttctctcagcttcatcccaacctgatttcctacagcacctcaaccctataggggatcatttgtttctggtttacctgctttggcttctcaagcctctgcttaggttgtgaccacttattcccaatttgacccatttttttcttgctagcatttgtcttatgtccttgccctgctatcaacccccagcttccagcctctgtgatattctcccctcccacatcttcctggttctgatgaatggagtatgactgaatcagcacattgaggagatgctcaagataaaacaggtttcacagtctgctattcatgtaaagcttgagaaaaataatgtgagctagaattggctcattatgccacttagtctacaaaatggaaagctgtattaattttaatatctataatatcagttatttatattacaaacttatgcttcataagtgcatgttcattattgcgttcacaataaattaatgtaaaaagttaatacttccagagctgtttcgttccaagggaaaaaggtttttggatgtggacaacacttggtttttcttctaggtaacttagtgtgagaaaactcttcctgagatccagcctacattcttcttgatgaaatataaatcagcccaaatcatttcttctttaacctttggaaaacttgtaaaaacctggttaccatactcttaatagttatagaaaaacttgaaggaaattattataccattttctggcagcatatataatcaaacaccaaggtcagaacccttctctggctgtggcaggctgtttttcctgtggaacgtctcctccggtcgctactgtaaatgagtcttggccttgagtagggtgaccacctcatcaaggtttgcctgggactgtcccattttttcccatcctgagaaacccttcagtcctgggcagattagaacagctgttgctccagccttgaattattactactgcctccaattaaattactgactttctttcattggaatttgtcgagcccctggtttccgtctcataatactgacatcatttttctgcttcaaactgtattcctccccctttctccccacacacatccactataatataaataatttgaggaaatttatcctttcattaatataacacatttgtgttcagtgcctcctgcatgctagtctctggagaaatacaaaattcatgagataaaaaccttgtcctcaaataacttaaaggctatctgaggagaaaagaaaaaagcaataactatataacatggttattaactatccatgttgggagaattttccagataaaaagctgtgggaaatctaatggaggaagggtgggattatttttagttgcaggtgtcacaggaagctgtgtggagaagtgaggattggaactgaacggcagtggattggggttagggaaatgggtggtgctggggggtgcattccaggtgtagagaccagcggagctacagcacgcaaagatttctccttattcatttctgtgtcctctctgcatctaaatctagggaccaagttactcatttatatctgtcaaaatgaacatacaacatcgttagaaatggcaaccacccccgttaaaaactgggccagcttcaaactttatacgtgaaaaccaaatgagctaggtcttcaaagaatcccagagaaatgtcatggggttctcctaattaaaatcagaagttcattttcaggtgatttcttagtcatgcagctggaactaaagtaaatctcgagtcccaggaatgagcatagtgggaagagagagaagccattgctcaccatggggctttaactgggagctctcccctgaggtatagatgagatcagagaacaaagccataggaaagacagaacaatcattttgaatacaaagtgatcaaactgctttaattttctatggaaaatgtttttctttccagtgactcaaggaggttgaggttgatagcttcttacacgacagatcacaaatttgcagtcatcctttgcatttgagaagtaattaaacatttgtaaaatgacagttttcaaatgaaatgtctggccagagtctccttcagaaataatgatgtggtttctttggctgcaagtaatgacaaagaccatcgagcatcccccacccactcccctagttccgagcgccagtcttcagcggcaacgattgcaaaagttgctctcaccgagttcattttctctcagtgctcttcggcagccaactatcctgtgagataatgtgatacaaataactgcactttgccatggtttcaaccccttcctcctagtgtgttttgtcgtaagtgatgacatcaacgaagatgggaagcttaggtttgtgctgctgaagggtcaaactgatagagctttcatagttaaaagtaactggcaagagatttacagccagatatttatattataggagtttgtgtcttctccagtggctttggcagagttgcctaactaacctcaagaaacagctgagtaatccctctagatgtaagcactctgttatattatggagaggaggggctggagatgcaggcataggtgttcctaagctagcttataaattagccaggtgccagtaggaatgttattttataaaactgggatatagagtaattgattctcatgcacaagcatggttgcttgatttacacagagctgatttagcattttccttgctaaatttatttgaaaaatgttaacgtaacctgaatttacaaggagaaaaagtatttgtgtgtgtgtgtgatggttattagagagacagacaaatgtcagtacaaggaaaagaataacttctgcgattgatattttatttttcctttattctcattcactaaagtagatgtcagcaccttccatgctccctatactgtgccaggcactagagatacagatatcgatcagacagttcccaggcattgaagagaggtaggtaggtgaaatgtaaacacgtgcaatgataatgcagcattaacgcagaggtatatgaatgaaagggtgatagctattgtaaagtaacacaaaagaaggaacaatgaactttgcccaaggaactgagaaagctttcctggatgggtggcatttcaactgactctttaaaggaagagcaggaattgagccacagaggagccctacaagaggaagcgtggtgggaatggtgtgctaagcatacagcactccgtgcaaaggcttgcagcctgaatatttgcatgctggtgggtaaatgtgggttgcttggtgtggcttttccaagcagagcatgagggtaggcagagaaacaactgtggctggaaatgttaaccggaacctgccaggagtagcttgtgaatgaggcagtgaggcctggtggaaagaacacggccttcgaagttagaccctgtgaggtcaagtattcacattaagacttttgacaagctaccaaaatggtctgattctcattttctttaaaccggatgtgagaataataataaaacttattttgttatgtcattggggtgaattcctgacagaataggcagacctacatgtcagttctttttgagaccccctgcccttgcatgccatgcacagaagggtttggcattgattctgcatgtggtgagaagccgatgagaaacacgaattaaagaagtgatgggtcagttctcggtgtattaaaaaagtcactctcacactagtatgaaagaaggcctgcatcatagtaagacaggggaggcagagagaccagttggaagcctgttgtactattccagaaaggaactaagggcttggaccaaggccaaagtggtggcaatgaaaagaaagaaaaatatctcagatatattggaactcacgacacactggaggtacacagtggagcaggaggaagcaaggatgatgcggtgatcagattctctggtgagcaaaggaactccctggagtaattgcgtgcatttatttggaatacctgtatatctactgaatgccaggcagcccttaggaagacccaggaggggctggtttcctggagtatacccactggtaaaggttagtttactctccagaggctccagtcctatattattaccattgattattcctgctacaggtcatatttgcaaagagcgacataatcattttttattaattctcttccacaacaagatgccaagctagattgcccagcatcttcagcaaagctgggactgacaccctggagtctgggttcaaccaactaacctcctctctattacttgggctttactgaagcaagtaccgtaaagccttacttaattaaaatcaagaaaacaagctgcactggcagggtttgaacagcctccagtgttagaaagaaataaaaatagcagtccctcttccctggactggtcagaatgataaaacagagacatagtattgtgtctctgagcagagtgtggatctgaagatgcaaggagctggctgctgactagaagtatacagggatccataatggcttacagcagtcaagcacatagaattcatttgagcatgtgctttctgagagaactgtggtttatgtcttacatactttggtttattgaacccttccaataatttatcttatttttatttatacataaatagatgcacatattttggggtacatgtgatgatctaatacatttatataattcgtaaagatcaaatcagggtaatcaaatcacctcaaatatttgtctcttctttatgcgagaaacattcaaattattttcctctagatgttttgaactatgcaatagattattgtatactacagtcaccctactgatctagcaaacacttgctcttatttcctctactgaactgtatgtttgtacctacgactcaacctccctttcttccccactccctcctactcttctctgcctctggtaaccaccaatctaatccctgtcttcatgagacccatatatgagtaagaacaaataagtctttgtttaccccttctggtagtgctatcaatagtgttgattcatataaaaggaaagtgaaacttagatgagacaaattacctaaaattacacagctaatgaactcaccgagctgaagctggaacccaagtctgactctagaaccatgccctagccactgtgtgatatgtcctcagtatagaaaagcaggtggtttaaggctaggtctctattctttgtgtgattcaaatatacactgtgggcttctatcaccagttccagaacacaaggatacaggaaccacaggcccgacccaactcaatgtggcccagtcagtagttactgaggagttcctcctaatgtattcaaggtggcgtttggcccttcagagacaaaagctccgtgggaaatatcctggcctccatacttcgtgttcaaagaacctacagtccagttatagattatctctagagaccccacccaacctcatgatgctgtacaaaaggctgggggctccaaatgcacagtgagcatcctcttccctggcagcaatgacaagaggctaaggggtccagttgacttttaagatattccactgttcacagtaacagcaacaacaacaacagaaaatcagtaattataatagtaattagtccaagccctgtcatttgctgggcacctactggtgactcaagcaccctgctggtgctggtaacttcactcgcttacttaattagtgatatgattgaaaagtctgcctgaaaacaaaattccatcagaagccaaaatataaccctttttctctaagttatgccacacatactcatggaactgaaacctaacagacagaaacccctgggaagcaatttctacatactgtctctccaaattggctctaacagtactaacagaaataataaaaagaactggggtgagcggtgggtggggggagacactgctcatctacttatcaattccagccccaagtccatgggattttttcttatttcacttgcagattttttcttcattctagttcttaatgtatctttgtcttctttttcgccatctcctaacttcaggaacatgccctaattggctcctgggtgcagtcacggcagtcacggtcccattggcccagaagtgggaaaaggggagaggcttggaggctggtccttgcaggatgatccttgcaggatggctttacttggtgtagagacagaaagtggaggtgggagacgggggtggtggcagccctcctgggtcagctcttcctggaaagccctctgactgtgtgccttttccctcaaattacaaagcaaaccccgcagacatcatcctgtgaaaggagatgctctgacaaatgcaggggaatcaggcagcggaggtctaagacgagcagggcagaggtcaaggaagtcagagtatgtctgggaggtctggacagctgccatcgtgggacaggacgagcgtctccccagcaggcagttcctggggctgctaattgctcatttatctatatatatctggcttaagcaagggcaattgtgtccagagagaaagccaaagagctgaagatggatttacgaaggcacaatagatccataaaagtagatgaataaataaaggcattaacttttaatgtaaataggactgaagcattctcattaccttatcttttgaagatataagacgaaattccttctgccaatttgaacagctttaaagtgtacttgaggacacttggaaggaagaaaaaggacccaagtaccagaaaatatctgcttacaggtgccaagggtaactcaaaagtattcacagagctggagaagtatgctgctgctcaaatagctggaaacctaaccagagctgaaaggaagctgctggtcactggcaaaccatggactttgctcttctcattcatttgttcacttattcattcatttattcagtcaatgtatattgagttcttcctatgtgttgagtacctactatactatgtagattggacatggacaaacctgtgttctcaaggaggttgtggtctcaatttaggataggagacattctttatggcattgatgaagtctgagtgtgtctagaaacaatctcaatattccttgacactagactaagttatagctggggctcagggccgggggagccaaaacaaaaaatgaaggaaggacaccagttagtggtgtcctttttatttatttttatttatttatttttttgacacagagtctctatctctgttgccaggctggagtacagtggtgcgatcttggctcactgcaacctccacctcccgggttcaggctattctcctacctcagcctcccgagtagctgggactataggtgcgtgccatcacactcagctaacttttttttttttttatttttagtagagatgaggtttcaccatgttggtcaggatgatctcgatctcctgacctcatgatccacccacctcggcgtcccaaagtgctaggattacaggcgtgagccaccgtgcccagctgtggtgtcattcttaaaaccatggaaacaaattattttatgctgcaaatgttctgacactattaaaggtgcatttgcatgcattatctctagcccatgcaatgcttctgtgatcaatattattgcatttgttttctagagaggacacttaagctcagagaaacttaatgcctcaccaagtcacacagctggcgtgtgactgcactatgattcttagtattttaactttaaatactccctttccaccattctaaaccctctgcatgtcagggccagattaatttttactaaaatttatttcttataatgggtatactcaccaccttcaaaatgtccttttgaatggattccaagttccttagctcagatttaagcctccacagcatctgattgtatgcttacattttggtcttacaggccatcaatgcttcactataccctctacatcaattaagccaaactacttgtcatttctgaaaactttgttagtttccccacattcatattaattaaaaaggctgttgttcctgattaaatgtgggaggcagagaagaagaagatgacaaagtcgattctgcatttttcaaggctgagtgattaggaatgttggcgccttcaaacaaaacaagaaagtcatgaagagaggtggcttgggggaagaggataaatcttatttgaaagtcttgtttgagttggtggtagaatgttcaggaggaaggcagcctggcctccacttagaaaaggcctcagagttcataagggcatcagagagggagctgatgattttggaaacttctacaagggagtgagagctgaggcttcaggaatgaaggaaatgagccaggagaagggactggaatgagaaggaagaactccacactgaatcttaggaaaagctcaggggcctgttagggttgagggcgggcaaatagatgtaagggaaattagaggaaaacagaagcaaggcacggactcctccctgtatttttttttttacgaaaataaacacaaagaagcaagggataatttggttcccaaaccaagactcctcaactagctccatgactttgaggggctttctttaactgttgaggacagacgcatggagcccaacagaggtcacacatgagctcttgctcatctttatactgtggctcttgctttccaaataaatatttagaatcatttgctaacaaatgtggagcaccaacaagtattccaggcacagagcatgaaatggcgagggagataaaggccctgacctggtggagttggctttcttgtggattacatccccttgcaagttcactgatagagctatagcataaagtatccgtaaagtattacgggtgctgggggactccatcagggaggaattggaagctggatcttataggatacaagatcattgctaaatctaggatacaggatgtaaatgagttaattaggaagatatagtacaattaaagagttagaaagcaagaaatgtgagagcaccttcaagtagtttagtattgctagagtacaatcaggtaggaatacagttttttgcaagcatgagattagatagaaaagcatgcaccatttatacactatgataagttttgatgttatccttcagatgataagaaaccaccaaaaggtttttaagctgggcaattatacagttcagattatatttagaaagacccttctgacagagggaggatgaattggagaacagggaaacagggagatagtttaggaagctgctgtagttatccaggcaaatgatgataaggatttgaaccagaggagtgatggtagagatacagaataatgtatggatttaagaactcttttggagatgaaattgcttgaactggtgacgaactgaatgtggaggatgaaagcaaggagctgcagaagatatacataggcctgcctttggtgaccaaggggattatagcacaagatacaagcacaggagtaggtactggcttaaagtaaaaaggtattaaggtcagttttgggtgtgttgaatttgagattcctatgatggatcagtaggagatcactggcagacatgtgaatatacaaatgcaaatctgggagagtctaggctggacatacagatttaggaagaagagggttaattcctggagaacaccaacatttctcaggcacccagatgaagagcaaactaggatggaaatagagaagctctcagaaaaagactaaatttgtacaagttttgtagaaatgaggaaaacgcagaagcctaagaaggagaggacactgatctcaagcagagcagaggtgtccattaaaaagagaactggattaagcagtcaaagcacaaggtggacccccatgatgcaactcactactgtccgtgacctgagcactaagccattggtttagggaaagtgaacaacagtgagatgcagaggcaaacttgggccccatgtggttcccacgattccttttactgcattgctggacctcaagggacgctaaggttgttctacatctcctcatggactgggatctaatttaggtggcgcaaatcatcctacttaagagataggggtgagtccacaggcaatgcccaggtcttcacaggcaaaactgatttccatgaaactttaggggaatggagaaatgcttttaaaatgcaacattggggaccccacgcaaaggagtaggaaggtgtcgccagggctctcttggacaactgctgatcatggttactcagtatgtgtgagagaaccaaactcttgccttccgggactcagaagcaaacagaatttttttgtaactgtaaaatctaggctggtagaatccaggctgtctatattaacctacgaaaccaagctatttttagaattttaaaagagaaaaattaaatgcctttcacaggaggtgcagtataacaatctataggtttgggagggtttttctttgacatttccttgaaaataacacatcttgtaggtgagaatatatggtgtcgatggtaattgcctttttgctggagctacattttcattctcctccctttctcctccaatattaattatcaggactaaaaatagtccattgtgagatctttgtgcctctgggaggcttctgtggaaatctgacatctgtgcaggaggctctgctgcgatgtgtgtctctgtgaagctgtctcctgtttgtgaattcagtaaacacttgcatagtgaatgctgaagtgtctgtctctcataacggttgtgagtggcagtctgtgagaacagtgtctttttgagcagacatgaatcatagtgcctggagggaatagagaatgcatggaatatttatgattaagagcattagtaacaatagggaaatattgatacaagaacatgcccctgtgtaactgtagtgtgcaaccaaactgccatggcctcttatagttttcctttttgtatgtacctataaacggatgtacccctcaccctgactccatttggagaaaaataatataaagaaacttttaaaatagaaaaattaatgagttgtttatatccatgatcagtttaggtggagttagatgggtgctaggaaggtcttcaaggaccaatacctagctgctggaatcagagactcatggatctgaactaaacctcttcctaaataaacagccatcatggctggtcaagtcattctccacttgatgagatttcatttcaccagatatcctttaattatcttcttggaatgaatgttagttctgatgggatgcaaggtgaggagaaggatggagggttacgtggtagcgtggatataatattcgtgctttctaatcaagacacaggttttgacaaatgagtgcatttctagggaaagcaagattgattactttaaaattgggctgttctaaagaatctgagatacatggttatgtaactgtggggaattggtttgttaagtaatcccaggtggagcttcaaaatggggagctctatacagtcctggagcagaataagagctctgggaggcagggataggtctaggaggaggctgaggggcagaccagggaggagggcattctgagcaggagaaaccatttcacagctgtgcccacatgggggtagtttacagagagttgttggtgctacagaattttttgttttaatttttaaccccaaatagtcattttacagtcagttcttctgttcaacttgacagttattatttaattccctcaaattatttaatttgtatatacattatacattggcaatcgaaaaacaaatttgattaatgttaactgtttaagccaggcacagtggcttacgcctgtaatcccagctactcaggaggctgaggtgggaggatcacttgagcccaggagttccaagagttcaagtccagcctaagcaatatagagaccgtgtctctacaaaaaaaaaaaaaaaaaaaaaaaaagttaactatttgaatcaacagatatttactatcacctaagtataagaatgttacaagtcactcaaaattatgaaatatgatatacatttaagggttgagaaatttacctgttataataacctgggtatttatctactcttatagtttgcatttaacattatataaattactcactttgaattaagaatagcttttggtccccaattattttcttgttgtcacacgtcatatatcagggttgcagactagtcagtcggtgtacaaaggagttgaaaatgtacttttctttttagcctaagaaaaacataatttggaagacaaatttgttgcaataaaaaacttcttacagcccctctcatacaaaataaactacagccacttgtcatctcaaataataagcaaggaaactccacatggagaggctgggaagacccatgctggcctttggtcccttcgtatttaggcctacgtgaagactatttccagagtgttgtcacttacagagtcttcgtctttgcaaagatgaaggctggccgaaaacatttggttaaagatatccacccgagtgagtggcttttctgatctctggaccagttggtctggtatccttatctcttagaacagagcaccattaagctttttgtcctggttctttgagttttccaaattatggcatgggagcaccagggttcagtcaagatgcctagagtttgctgtaggagcacatggaccaagcagctcagaaggacaccccacagctatgctgtgggctccagatcctgcccatacctgttcccttaaacggatctttgactagagcgaatcttcttttattgattgcactgtattctggagagctctataacatttcatttgaaggcaaaataatgattgttcggttacataagtttgaaaaacattgattgagattatccaaaagcgtcccagaaaataacctgattttcccctaaaaggaaatgtttgcatatactatggctcaatttcactgtgaatattatactgcagataaaaagaatgaaatacatcagtatgctgttaaatagggatatatagtaatagtgttaagttttaaaaagacaaatgacaaaacaatatgtacagtatgattccattcatgtaaaaaatatacaaatcaaaactatagactcctgtatatacaactaggtgtaggcactcggggcttcttctgcactgaccttttggtaagataacaagtggagcccaccaaagcctgtcagaaaatgagaaatgtgagatgtgagcctgccatttggagttgtatttttgtgtcagagagcttcggtttatgcttggcttaggttttgtctctttttctttcctcttctcctcctcctcctcctcctcttcctcctccttccttctcctccaccttcttcctccttcttcctccttcttcctccttcttcctccttcttcctccttcttcctcctcctccttctcctccttcttcctcctcctcctcctccttcttctcctcctccttcttcttctttttcatagtttttatttttgagacagagacttggtctgtcacccaggctggagtgcagtggtgcaatctcggcttactgcaacctccacctcccgggttcaagcgattctcctcccacagaatacttgttcccgagtagctgggattataggcatatgccaccactcctggctaatttttgtatttttagtagagatggggtttcactatgttggccaggctcatcttgaactcctggcctcacgtgatccaccaacttggcctcccaaagtgctgggattacaggcatgaaccactgcacatggccatgcttggcttaggttttctgtctgctgaatagtgacaaagttgatcacggaactagtaaagcctcttcctcaaaactcagggctgagctaaaggagagagaacaatctcacacataaaagccaaatatattttttaaaaggttagcttcagtatccagcagagaaatttttttaaaaaaaacataaactagaagatgctcacaaatattgaccgaaccatgggagaaagactattaagtgactcaaatttcaatgtataaaggatgatcagtaagggagtgatttgtattaaattcagaggcagatcattctcattgcacttctctccatggcctttctgagaaacaaattatagtgcaaatctattttttgacacaccaaacattatgtaccaacttattcggattaatattacacagtgttgatgaaattttcttagcagtgctaagaactaaaatgatagatttttgttgttaaaaagaatgtgttgatacttgttttcatggtgactattagttgcatatttaatttatagaaatggcgtgcgttggaaattattgtaatagtttgagatattgagcatctgcgtgtctcccatgcctcgacttaaaaaaattcattgagtgtctactatgttccaggtagcctgcaaggggtcacaatgcaaagataatttttaattgtttctaacattatgaagtgaatagcctagtaggtgaaacagacacataccaaaaatagcaataaaaggcaatagatgttaggaaagaggttggcaattgctaatacggggatggaagagagctagactgcgaattccaggtgagcaaagactgggttgcgtctctttttctctgtatccttacgcccctcccacaatgcctgatacttggtatatgtttaataattattggtagaatgagagaaagaacggaactatgaatggagcgagggttgctggagcaagcttcgtggaagatatgaccttttaactgggtcttgaaaaaaaaagaaatgagtaaagtggaaaagaaacaagagggcgttccaggtagaggcttagcacattaaggaaaattcacgtcaaatgtgtggaatagaaggaagctatgccacattaaaatgcgtatatgtaatgtgttaaacaacacgcatacatacacagataaaggatatttttgttacgtgtgttttatccttatatattttatccaaatattgggtatcctatacatataaatttaaaaattctgcagctgtgaagccatctgctctagaggatcagccgtggtcaagccctgccttccctgttataccctgatgacagcatttaccatcacaattgtcactcatgtgttctatgcaaacctcgtgcttttcagacctcgtgttaatcaataatatcagtagtcactgtcaattgttaccacaaaacctttgaggagatcgaagtcctgactgaaatgtgatctttcctttcatttgtcttgcatctgataaagtttggggctattccaaagcttgttagcagaaaagagtcaagaataagaggccagtaagatcgtcagaatcatcacggggcaagcagatatatgccagccatatgttaaaagcctttagagacaagttaaacagtctcttctaaatgcctctgtgttatcctctttcatttcgctttattcatcatattcaacaatgagaaaatatgtcttcattatttaatacctttgcacatagcatattgtgaaatggagtagtaataaagtctaaatcaagctgtttttaagctgaggtagctgcagaaagttcctagaagaatagaaagataacagtttagagttcacaaagtggcatgttggttctttctctttctttgatttttaaatgttatcacactgtatgagtagacatgtcttgtgttctatatttagccaaaaggatagtgtctcaataaatgctatttgctgtctacatagattctatatgagagaaggagtaggttgggggtgagggtggtgatatagctactagaaattcaagtgcttcaaggaggtatgctgtagatatctgtgtaagcaaaaataccagctgtagctcagctacctgaaaagaaggattatatcctctaggatgctcttaaacaatctagtcaatttatgacatacctatttcaatgggaagccaattcctgtggctccattttgctctactttttcaaccaaaggtcatttttacatactttgggaaagatagatatggtgcttaggaattaagagtaaagaagatagttttcccaagactaggagccctgttcagtttaggtaacaagtctactaatcacagaagcaaaagactgtcctccccacctcctagatctgttgtctacaaactgtttcacacaaacacaacacaacccttgacagagtaggtccttagaggtttttgctctagtccttggggtctaggggtgcatgcatatgcaaacttctctgtctgtcattttctccctttctatgtttctttccttactggccccaacaaaaaaattaagagatgttttgtcttcatagaataaatgttcataaacaaaagtataaggcagaactccaactgacagtttttgttaaaaaaaaagaaaaagaagaaaggagggagacacatagaaataaaaatatagatagggcagacatatgtctgttcaaacccatctggcctcttaggcatttttgcaattggtactttgtccaggcataataatgacaataataacagtagccaaattttattgattatttaactttgtgtcaggcactatgataagcactttagctttattttctcattcagtctgcacaaagccactatggacatgacatgattatgtcatgtatgtgaaaatccaatctctgggaggttgaattgcttgctcactgtcacacagccaagtggtggagtctggacagtatccagatctaactgattccaaagctacttcttttaactaaaacaatgtatcacttactcattgaaattgtagccaaatacaatagagggtaagtacctgttagaaaaagctagtttgatttacagccaaatcaaattcaggcatatgctgtccatggctcttagctgatccaacccttgtcacttccagagataagcaacataaacacagatttgacatagcccaagaaagcaagccaattaaaaacttccatggctgatgcctctgccacgtcctcctgatgccctgagccttaacagcttaagtgctggtgttgatctcctccaagacctttaaatgtcatggacggaaattgctattttgttctggatgcacaggtcctaactgtggggctcagagagttctgtggagtctgtgaaatcaacacatgccccatctcccccagatgcctttacctttccagtgcagtagttgattgtctacaggcagctcccagggctgaaataggtttcagacttttcagagttttcattaatggaaacttgcaattcagcaaaagggaaaaaaagaaagtaaaagtgttgtggtacagacaggtaacagcagagaggaccatctgcttgttaataacttgcccacagattttcatacagcaggacagggacacatttattatgtgatgctgggcccattccattccactatcatttctgtagaaatattattattattacttgcacaacgtgctatattttttaatttactttttaaaatcctcctctccctggatcatgttctcaatatgccttttccctacctccccgacctccccctcccctttcctgatgtaccacctttttctcagctctctcacaaaccgcagcacagcctcaaacagaggccatcatcaccagcaaaaacagtctctcagttcacagagagacaaaattcactgagagacagaactctaattacatacattgaaaataatactttccaatacaggtcaaaatgtagcccaacaactcaatgatgattttaaaattttgatttaattttgtattacacacacgtcttgaaatagagcatatctgccttgaactcggggttgggaaatctgagtgataagaaacatcatatgtaattctggctctgccattaactagtagtgtggacttagcttttatgtataaaataagtgcattggactaaactgatggattgattcattcatttatgaagatcagaccatttgttattttccccagatttgaccagcttagattttcatacctattttggacatggtgatataatcggatattcacccttggccaatagactttcttgagttaaaaccagcccatccctttgaaaacttatgcttttttctccctgtacctagctatgtggtatgtattgcattctgaaatgaatatggtattcataatttgacccaaaattatttttgaattagaaatttatagatataaaaattattacaaaagggttgaatgtaaatggtaattttaaaattataaaagcatacatttcaatatattttaaatatatacatactattactccattatctcattgttatagctattgttatattcttctcaatcttttctcatgcatatatcttaagaaatttagtgatttattgacagcatcggatagcaatatctccatatctgctccaggactgcatgttattatttaaaaatattgttggcaaatctgtaagtgaaaaatgtcatgttaataattatttaaccttcctctacttcagcacttatgaccttatgtattttctttttaacctgcctttttatctcaagggtaaagaatcttcagctcaggtaggtttgcatttactcacagcccctttggatgttgctttgtaggcttatagatggtgaagcagaacaaaatcatagctaagcacacagacaggagggggcacacatccttgtttttctctttattatttgtgtggcattaatcaaatttgttaatctttctaagcttgcagtgacatacaactttcttcattactgttacgagaaaattgactgagacagtatgtttacacacttgctgcactcttgagcactctcaaatcctcttaaaatgttcatcattatgatcatcattttttcctgtaatccattaaataattctttctcctagaattgatttttcatggttacaggacaagtatcagtaattaattaattgcttgttgtaaccattaattgattaatttattctgtgttcaactaatcctaggagtcatctttattctcttacccaagccacaggtgattctgttggctgtacctctaaacttcatctcagagaattctctccatttctctcccatgtctagtgctacaatgatctcagtgatctctcccctgatctgttcagtctgctggctggcctttttctctctaactttttctgcccagcttctacctccatccattttcaacattgaaagcagatctcttctttaaatatgaaggaggctacatatttaattatttcgcagttaaattcttgaatgtggtctaattgtgtttggaatacaatggacgctccttgccatggtctacaggaaaccgactgaggattgtgtttggaatacaatgcatgctctttgccatggtctacaggaaaccgagtgaggtgcccctgcctgcctccaccacttcgccttccactgctctcctccgcagctgcctttcccagccacaccgacatccttgctggttctggaattcaccaagctgtttccctctgtggggctgttgaactttctcttcaccctgcctggaatgttctcctcccagaccttcacacaggctcctgcccagtgccatgttttcctgcacacctgccctgactttcttgcccagacttcagatacctcatactcctttatagtcttttactttcttaattaccccatcactgtctaaaattattgtcatttctatttatgtcttccagtgctttttttccatttctcactctccagaactccgtgaacatgctctctcctcgaagagaaaggcagtattttctatgtattgctgtacgcctgacacctacaatagaatggaaaatcagtaactgttagatgaataaatgagcaattattttgtgtgtttactacgttccaggtacacacagaattactaggtcttagaccaagaggttggtcatcaatcatttgtgattttggtgggtcttcctttgatctttgtacattctggaccactcctttttttgggggaaacatacaatgaatgcaggtacgtatgtaaccaagaatgagctctggtctacgaatcctggttgtgctcagaaagcttaagccaagcatgtcaaggagggtcctgcactgcaggtctcttgctatgggcatgctcactcactggaggaccccgtcacccacccaacaaggtaaaccactagtttatatacatcagacagctcaaagtcttggcaaagcctgggcctggacagtcaccagtattccagcagttgaggcccctggccctttgctgtctctcaacctattatggtaacttggatccccattttctccattttttttccagataccagccaggtaccctggcttatcctgggttgggtttttaatttttccccacagatctctccctccatatgcccctccctcaggctccaaggtacagcaatgaactggtccatctctcacaatgcctccacgtgcacaggcctgtgccgatatacccgcaaaacatgcacactttgaaaagcagcttgtggccccctagacctttggaaaatattcctcacttagacaaagcctagagagaggcttccgtctcactttgacttgatgagttgatattgctcttcgtatagctttctatttggaaacaactctgtttatatcacacacattttctgtatttctgctgcctcattttttactattaaggacacttgcctagaaacagaatctatactttcttccccagtgttcatctcctctcactgcctgttcttcacctgagtatatcacgtttgattgctacactgcaaaactgggcacagctttatccccactatatagtatcaatctgtttacccatccatctttcttcctatctttatacacacaagaacacataaatgtctctagtgaaatgtgtatgtgctaatatttctcagagatgcagggatgatgtttccttttattcctctgataaaccacaaaataatactgtactcagcatctacgtaacgtctcatttattttaactaattaatcctcataggtgcctgtggaggcagaatcctcactgttaccattttaaagatgaggagactgagacaaagagagatgaactcgcttgttcaaggcgatatgaaaatttctcagcacagtggaggattaaaattcagagtgacaaactccctgatcctgtgattagatcattagatcctggtgccatgtatccaacctcttagaacttggagaatcaggtacttaatattgctaaaggaaattgatggaaaggtcaaacataaaaggtacaaagtacagctcctcttttactctacaagtaatgaagcagatttcttagtgtttaatttaagaaccacttggtatatgaaacacatttcttgagagagagaaaaaatggctttgtgtctagactcccagtctttgggattaagagccacctgcctggttcaaggatctgcatttctccaaagtgctctcctcacacccgtctctgtctgtggcgccataatcatttccacagcaactccaaaggggggcgatgattgtggcatcacatgcaggagattatacagcctcaggccggggataactaacagaaggagagagattctcattgaacaacaatcttgctttgtgcaaatctgagcaggagagaagacggaagggaggagaaatacaggcaatctaagatctaggggacattggttttaaataggttgtttttcaaaggtttctggaagatactggttcttctagaggattatggaaagtgctgagataattaccttagccttataaacttaaaaaatatacatttattaaaaagtgtgtttagtgtttggcaagctgtcagataaattttcaaggaaaccagaatctccaggacgaaagggcacccggcaggcagagtacacaaagggatgttgatgtgttggacagtggcccacaatgggaccctggtcaccgcttaactgctctattgtttatgctggtgtcatgcgtgtgtgccgtttgtttaattcatgtagagtcatggttaagagcagagtctttggagtcacgaaaacctaggttccactaaagtgctaagtaagctttctaatctgtttgactttatctgtaaaacgtgaattttacctacctcatggagatgttgagaattttaaataaaaccgtccatggaaagcattcataacatggccttataaaccacagatgctgaaaaatcatgattcctctggttattgttattgatattaccaacatgaaagccatagatgattaaatgatctgcttcagacatccattttcttcatttctgtgaaatgaacactgtactacacactactgtgtagatgtggtcctgggggaggcacctttgttttagccttagatttgttcatccttccattcatttacccatgttcattttattcaaaaaatatttgaagtaggttacagaaagatataaaataaattttaaatccagacctctttattatgtatataatatatatcaagaaataaaatttgaatagtaagaatatgcagtttatgtattaaaataaatgttataaagccctgcagaactaggaagataggaattcagctgtgagtttcctgatttgtgaggcaaagaggaaaagaaggtcattaaaagatctgcattgcccataaatagaaacacaccaatctcacttaggtcaggggtcagcaaactaagcccagctggccaaagcatgagccaaggagagttttacatgttcaagtgttgtttaaaaacatgcagaagaataagctacagaaacagcatatgatgcttagactgtactagttactctctctggcccttaacataaaaaatttaacaacttcccagaaaaaatatctaaggaaaatttctcctccgcaaaagagacttcctttccaattcatcttgctccacttttcgtcttcttaactatgctccagtcactctgcccattctcctattctctcctcctgggttaagcttacaaaggagaagttcctctccactgtatcctagtggcctaggacacccggcctttgcctggtacttcaactggtccttcaaacctgcacttaaatgttacctcctcagagagccttctctgatcacctagtccaaaatctattatcttcttgtgtctcgaatagcaacatgttactttccattgtagcaattttcagaatctgaaagtttctattcattcacttacttgtttgtttaattctccatgaggacagggatcatgattcagttaatctcagctagataattctagttctcagtatttggcacaaaataaacagtaaataaacatttgttgaatgaaaaaataacaatagagatgttcaatgggctacttttttttatagcatccacatggaaactgtaggcaaataccaaagtgttctttattaaagtggtgttgggtgagggattaaacagtgtagaggaagttgggagttttggtataaaacaatggtttctatgcatttttgtctggttgattctaaaatctatgatactcagaatattagatggattgcatattcttcagactatctttgtaccaaattttcataactgatggaggttatgttcactttcaaggatccatagacattatttattgcgtatcaaatgcaaaccaagataggctatatcgtgctaataaacaatcccagaattatagagactcaacataatgaaggtttatttctcagtgttgcattgtagttatatgcgagtttgggcagattatgttagattgcattgcttggaacagaatctgagatagagttgcttgccgagagtttattgggaagtgcttctgggagatatatctgtacagaagtgaagaaggcagaaccggacagaaagagaagctgacgcacaacctggctacaggtgaagctgtggccaatccctggtgagactttcattttcctcaatcagttagacactggccatggattctctcctgagtgggcccagccttacacatggaagtcctacatgtaaaagccattcccatagagaaactcagttctgagctactgtcagtgggtattcctggcagccaaggggcagtgaatcatccctaaagaaggggctggagcagagctgctcacatctgcttgcttcttagaggaattgcagtcatctaggaacagctgttcaaagttttggaatggtcttgtttcctaggttagagggatggactgtggaatccattgctgtagtaatacaaggctatgattgatcatttttatttttcttccactggcatctgttctagactccccccatctcagccagcatctctgctggtctagacacttggccttgtgggttgaccaagaacctcatttctgtggggtctgaagcctagtttctatgatctgctcagctgtggctactgtgtttgtccatttactattaaaaccggacatgggacatcaaaagctgccccagggaaccaccagatcccaaacatagtcttacctgatgcccccatgatgtgaaagcagccctaccaccaggattctgatcctggtgatcagaatcaattgtcgctatcaatgtggtgacttctctggttttctgatctcacggcatgaggagctttaagtggcctggtggcaactataatgtaaagtatggtgggactcattctgtatccccaaggggaggccctgcacctctgggaaccataacttctaccctcatatcctgaaattgcaagaacaggaagagcaggtttctcaagtgaatcactagggtagatggtaatcagggtagctcctacttctactctttggtctctgtactgatgcatttcacctcttgagaaaccagccccataaaatggaatacttacagggtactgccaccaagttgacacctcagctgcaattttaagaagccactcacaattccattaggggaggagctttagaaaagctcagaatgtggtagaatcatggaattctcatggccctatgttcatggcagtgcccccttaggtgtaaagtgggtgctctagctcaaggcaatattgtgaaggatgccctgtcactgaagaaaatgctcaggctcacgcatgaatagagaaagtcctttgtcctcctccaacatctggtcacatcctcagcatcactggtgtgggctgggggagaggcacatttgcagtcgtgatggacagcttgtaaatgtgctaactgattgtgcagcctcctgtgtcctctgactatggctttgcctaatcttctgatgttttgctgttgggctgcccaatcttatgatttgatgtgtctgaagaatcaagaccatgaaggacagctctgactacagtcatttgatgtctggtaagcagatagtttgtctcttcctaaaccacctaatattattgatgttgctttgtgaatgatgtatagttctctgttggagatgttatgtccttttgcaaacccctcagaatctttgtggagattcctctattagtgcttgctataagcttcactttgcatctttccccatgctagttagctccagtatcatcaagtctgttggtcatttggcttatgcctcaggaatgcttgcactgcagcctggactggctgcagagcagctttctattctggatctcagtcaacaaaggctgccaacttctatgtcacccagtaaacaaatcatattagtatgcccgaatgcatatgcccgaatgcataatattctgcctccagagcctgcagagggctcccaagccttgtgcttctttattagtgttgggaagcaagaaatgcaataatttgttctttatttttgagagactgtcttagaatgttgtagactactgaatccctaaaaatttcatgatatcatacacctctgagtctttgcagggttcattccttctctgtggagtaaacacaccttaccagagcctccaatgtacttgccactccttgttcatctgttctattgagcacagtgtcattgatatagtagattaatgtgatattctaccaagtgtccaggcagtctgtgtccctttggaatacgtcagaaagctggagagttgtcgtagccctgggacaaaccataaatgcacattattgttcatcccaggagtatacaaaatgcttctgattttcccttctgataggaaaggaaaaggatgcattcactatatcactgaccacataacaagccccacagtctgttttaatctgccctagcagagataccacatctggcacagcagctggaatgagagttactatttggttaagtttgtgacagtccactgtaatcacacatgacctatctgacttgtgtaggagaaagaaaaatttcagaggtacatggggatataacagggaaatatcacatttctttaagtctcagaaattgagaatctcagagatgcagtttcatttttcttttacttgctagtttgattagggatggggcagaggcatgtacaaagatttccacttgggcttcccgactatggtagctgttaataggcaaatgaaacaatgtgggtgcagtgcccatcctattgtacatttgggaactgaaatgatccccatgtgggtctgtggactcagtgcccccaccctacacaaggcatgggagaggaagccagctgtctcccccacacctcccttctagaaggcaggtgtaatgatgctttggatcctgagtaacaatgtcaattcagattctgcatccaacaacttacccctttccaaatgtgtggatgtttgagaaaatggctttcagtccctttaggaaggaatgaaggaatttctattgaaatctttgccagctctgtttcctgcaatggattctgagtcttaaaactatttaagatccagaaactgggcaagagatggtaagttttattgcggtaactatcctcagacttctgataatttgtccctgatttctttagattgtacaaattaagcagaactcatctctcttggctctaagtacatcatgttttagtccatatctccataggtcttgaaaaatttgacccatccttagtgacacttaaatgtcactcattgtgacaattgcccgatcttgattttgatgacttatcactgtgttaaacaaaattatcggggctgttgttttggactcagcttatgcactaggccatgataggccagagaaagccaaaatggagtcattcatgctaaatgtcaagtaatcaaactgaaatgttaaggaagcagataaatcccaaaagagaccagttttttttttctttttttattctgaaaacaggaaatttcaacataaggaagtccctcttctctaacctttccaaaaagtaaccttaaataaccctatattaaccaatcagtattttttttctgttgtctgtttccttgctcccatcttgcaaaaccctctgttctgctacttcccagtagaatttgagaccaaatagtccattcacgaatgagacagagtgacatcgatgcctaaagttttggccaacctctcaaaattgagaggttgaccaaaagtggagaattgttaatttaaatttaacccaaagctgcctccttacataatttagatttggcctaaagatgtctccatacatagtgaaccataagtcaactggatgtgtagacagactgtaacctactcttgtaacgagtctgccaatcacagcctatgaaggctgggccagtcataggcagccaactgttcaaataaggcaaatgggtgtcaccagtccagctgcttccataccttactttagttttctgtatgctactttctgttttctgtcgataaatgttatctaaccatgtggcaggcacagagacactttgaacttatttcagctctaagggcttgccaatttgcaaatcattctttgcccaattacattgttacatttaacttgtctaaagtttttattttacaactgttacctggcctgtattattggggaatcctataatctgttaaccattattttgggatctgatcatcttcactcttatcagggagcccagttctgtaaccacatttcacacagtcatctctgtttacagagagcagcacacatacataaacagaatccagttaactagctagttctgtagattaatggattattatcctttatgaaattaaaatcatattttattttaaataaaagtattaactcattgatcacttaaatttatcaaaaaagaaaaagaaatttaagtgcaaatgaaggaataattgaccttcaaataaacatattaggtcttaaaatatccctctactgttaagaggataggattgtgaaaaatcattaatagattggcttccctgtatctaggtctcctttttaataaaaaaatgctttaaatttaagtagcatcaattgattgcctccaatgaagatgataccactactatatttgcattttaccctatctttgctcctcctacctctacttgatatctgttaattttatgtgtatatattcaggtatataaactcctcattttgttctttagccacaaattcccgtaattttttaaatggccctggcttaaccatctgttttttttaaaatcttgtcttctatattgtcaagttactttttttgatttttgaattaatatgctaaattttggaattatgtagagttttattcttagatgccacatttcctaagtcctttcttgtttgaaaatgcttacatgacactgtattggtgaactataaaaaaaatcagcctataggccgggcacagtggttcatgcctgtaatcccagcactttgggaggccgaggtgagcggatcacctgaggtcaggagtttgagaccagcctgaccaacatggggaaactccatctctactaaaaacacaaaaattagctgggcatggtggtgcatgactgtaatcccagctacttgggaggctggggcaagagaatctcttgaacccaggaggaggttgcagtgagctgagtttgcgccattacactccagcctgggaaacaagagcaaaactctctttcaaaaagtaaataaataaataaaaaatcagcctatggctgggctcagtgactcacaactgtaatcccagcactttgagaagcgaaggtgagaggattgcttgagtcaagagtttaataccagcataagcaacaaagaaagacccacaatttcataaaaaaaataaaaagttagcctggcacagtggcacgtgcctgtagacccggtttctcaggaggctgagatgagaggatcacttgaagccaaaagttcgaggctacaataagccatgatcacaccactgcactccagtctggccaacagagcaaggcctcatgtcaaacaaacaaacaaacaaacaaaaaatagcctaagcataataatcttggatcaaacaaactttcttttaaaactgtaatttaaaaaaattagccaggtgtggtggcacattcctgtcatcccagatacttgggaggctgaggtgggagaggtgggaggatggctcaagcccaggaggtcaagactgcagagttgtgatcctgtcactgcactccagcctgagcgacagagggagacccagtttcaaaacaaaacaaaacaaaaaaaccaaaaaaccccaaaagtgtagagacattttcctattgattttgcatcacagtggtgtgcatctatagtctcagctactctggaggctgaagtaggagaatgcattgagcctgggagttcgaggctgcagtgagctatgatcactccattgtactccagcctgggtgatagcaagaccctatcaaaaaaaaaaaaaaaaaaaaaccttaaacaaaaaaacaactctgaagacactcctattattttcctcttgcagatgattcgttttgctgcctgcatgactgaacgattacctctttatctttgaaattaagtggcttaaatggaaagcatatctccatattgactactctatatcaaaatgtcctggaaactttcgtaactttccaattttaagagtccattcttccttcattttggtgaaaattttcttgtatcttatctttgaaaacatcttttatttcacttgtttagttgaatattccaggagtccaattagccttactataggttatcattgactgccttctatgtgtagtagtggtttccaaaatgcatactctgcatactttaatctagttatttttatattgttgctgttgtttgcatcactgggattatttaaacttttttgctatgtgggcgttttgattttttagcagtgtctattctatttcttgatagttcttatatcttttctccaagtctattgtttgaccttcaacttgtttacttaggtttatgatctttctttcaatgtcctttcattggtattagcttctattttattgaataaactgtttttaggttgttctatagtagaaattatcataaaattgttctctttcccaattgtacatgggatcctttgtcttttgcaggcactctctctctctgtttcacacacacacacacacacacacacacacacacacacacacacacaaagtatgtgtgaatagttgtcccatcatttctttctgttattgctcatgctaagatagctctgtctgggccctgagatatagatgatttattagtaatttgagcccagtttgtttcactgggggctgcagttcttgggttgactgtttacaactctacccatgtttccgggattgagacaagtcattccttatcatgggcaggtgtctgtcttcataagaatacctggaatgccttggaattccctccccttgagataatacactggggcttccgagtatccaccagtgccaggagcaaccccagacctcatggcagtcaagcagaagcagcccagtttctcccagcagacattgcctctaatctttagtccaaaaggaaaaagttttctctacctaaaagtatgtgtctgttagggttattcataagaaatatgtgaacttttttaagtccattttcaggtttaagatgtagggaggtgggacaggattcagagctgagctctcttctctgccttagttttctgccccatccccattgcttagccatcagaggccagcaaaataatttacttttcaaaacaaattttgttacctatgtgtgaacaaagtaggtgagatacagttcttcctttcctgggagactcccatccagttggatgtaactttatacacaatcacaaataaaccaaaacataggagagcagttagcctgacacctatagaacctgactaggtcctttgcattcagttggactaaaagcatatgtagacacaggggacaggatgtggttgatttgtttagttgtattgaagcttggctatttttgaagttaaaatatagctggaaacacaaaattaaatcattaaatgactataacccatgtaactgggagattgttgcttcaccttcatgatgatctataggaagcatcatgtaattcttggtgtggggaacagcatttacctgaattggggcaagtcacgcttggttgcctctagctactttaattctatcacattaaagacctcttccttttaaagactgaaaatgctgttgctccagatgtgtagtcatctagaccctcttccaaagtacataagacgtggtctggacaggactcaaatcccccagaccccaagctgctaggatcatttaatcaaatcttaccctcatgttaaatctctttcagagcattatatgaagcaaaaagaaaacaaaataaaaagaaggatggaaaggcccctatggaattaattcttctgcagaccagtgcacattgatttggttaaatgaattttctattatacaaggaccatgtttaactcttaagccactgagaagtgagtaaagggaggtaggaaggatagaaccggatagaaccataggtgtaagaactaaagcaccttctgtctccagttatactttggctgtagctttgggagaagattaaatgtgtgtgctgaaagtattagtattagataattactaagcaagaaaggcaaaaggtgttaataaattaagttagctcttatttcctctggtttattaaaaatatacaccttaagaatataatgttacaacattgttaaatgaatttgaaaatgaaaaaaaccctgcataatctctttcttctaacataactagttccatctgcacttattactttccagtcctgactgctatgaattcatgattttacatctattctgacagtgctgtagtctacattttcattgagcattaaatcataaatacttctcatgtttctttccatttaatttttataaagatcatttaaacagattcgtcatatttctccagtggacattctgtaatttaccaatatgtctccctattattggataattaagttgttgggtttcccccctgcggagtcatacagaaatgtgctccaagctgctatggtggcacaaagacataagggaaaacacagcgttagaaagacagagcctgcgttgtcccatgggaccaaataaaaacttgtttgctggttccccttctctcaggctgcaaagatgccaaggttgctaagagccagggttaggagatgtggatgttatggggtgtgtggtctccaggagggaccagagcctgcccttgatgagaactcataccagggaaggcgtaaagctctatacttcagctctcagtgttaactacatttttcacaagtcgccagtgcacacttttcatttttggattgctggtttccccttaaggactaagacaatctccctttgatataacagactgtacttctatattaatgtgtcaagttgctgcgaaatttactgcctcactgggcccattagactgctgagattcaactctgtcttcagcgtgtctcagtctatcagagctcgatcgtctttctcagaacaacttgtccccatgtgccactgtactgagcaaaagctcttaatgggatgagtgcaaatgaattcttcaggtcctgggaacttttggggataggagggtgctctctccctgaaaccatgagcaggagagacctctgatttccaaagggcattcaatcaagggttttccttggcatttctgcacacccccagttacattgccacttgcccataagctgttattaccaccatggcttaaaatcatgcctgatgtgcaactactctcattatccccagcctccctcatcacacacacacacacacacacacacacacacatattcattctaacttccctgtctcctttgtttgacaggcctgtctccttgacaaaggccacccaagtcactgaggcgtgtgaatttgcaattggtgatgaaaacactcttcccaagagaaacaaacttctagtcaccttgtacttctaaagtgcccaggagttcttgattggaggaagtgagcgatgtagatagacaacctggagactttgctagcacccatgatgtcatgacgcatactctgtgttaccacatttgtttgattaatataggcctccccccagttgatcattactgtctgccctagaaaaatggcagagataaagtcagggtgcattttcagttgtttctatccttttagaaataaatggctaattttatttcttaaaattttgcttttttttttctttccaatatagcgggaaaggggcaggtgtgggaggcttgttgattcagggagaagcacaaattaagcctgcagagtgatctccagagggtaaaacccaagtgtgactttgctatcatattattttccagccatgcatcaattgttgtcagttcttgaatatgtaatattgcatatgataatgctccctaatgggtgttcaagatagagtcagaatattgtacagcagcatgtgtcattgggtgttgttagcaagctcagatgagcactgttgttttctttattcaaaaatcatttgtactgctttggcacaaagacaggcagagctactggtacaattttatttttaacattctgaaccattgtaagcttagtgaactgtttaatatgttacattcaacaaggatggcttatacattaccaaggctttggaactgtcataccttaaaatgagtacaagttgtggacaaaagctctttgttataaagctccacaaatgcagaccagttagcattaggacttaagaaggaaccaagggttattttttatttttcaattttttgcttagtgacggatgtagaacatcctacttcatctgtagcagaatttactgctattgttttctttcaggcattggctacattgaacttgttttttttggaatatgatttgcaaactcaaagcattggttgaggactgtactttcaactcagcaaactcagtttggaaaataggattctctaattgcacctgtaaacagacacaggagacatcacagtaaaagctaagtgggctggacatttgtatgcagaagtcagtgctataaattcattgttgaaagcctggaaattcaacctgaaggggcattcatgcatacataacttagacaccaggtaaagtctgcttttataagacagggcaaaataacaatattgagttgcatattctttttttttctatgtatcttgtatatgtgcatctacatatatagtaacctgttgggctctaaggggacattacctgttttatcacctgttatgtactggtatcagtataactatgagcatggctgatgcgctgaaggatgtccctttctaaacactaagattggtatcaaatagttaagacttaaactccagaattttagaggaaaaaagaattgaaaggaacaagatctaaatcatgggttgattgtagacagggttactgagcagctaataagatcacttgtattattaattacagtctgaaaagcagaggtggtgtttactaagaactcaccaaaggactaggcagttatctagctagagaaagtttcatttctgattcttctccttgcgatcatcacattatttgcaaagaaaataaaatgactcatagtttaccattctgagtatttgtgttacctttcggtagggtattcattgctgtggttgtattttacatcccagggatgtggaagcattgctattaaagtctgatatgcatgtttccaatctcctatgtatatgtttgtgaaggtgtgggcatataaatatagttgaattgcaatcacactgttaaataacaatttttgaagtcttattttattttttaaaattaaaaattacataaaattaaagataatattttaaaaaatcctttaatttccgtggctagaattgacaatggttggtattttgcttagtcttttcctaacataagcaaccaaaagagtgacatcagcaagatagaggactaggaagccctggaccatccttttcctgacaaactcaccaattcagcaacagttcatggacaatttccctttgtgagaaatctagaagttaagtgaaaatatttcacaatccagacaactgcaaaaccagactcactaaagctgtaagggggattcaggacactctctcactggagtccctgtacctgacacagggccttacaaccaggaagagacccaagggagataaggggatggtttgtgcatccagcatgcaagcattcctgaatggggtcagactgtgatctcagtccttccagtcttggagcttggatgagtcagcagcctgggagagagtggacgtggcagcttggattggcagacactatagcgccctttcctggctcaacccacagagcaagcagacagaaacacagctgtctgcttttccctagggagggaaagagttagtagaatttctagctaggctgattggtaggagtcgtctcctgtatagaagaagtcagtgaagaccaggataaataatcaatctaatatgcagacaccaacataaagagtcaaggaaaatgaagaatcaggcaaagatgtcccaaataaaggaacaaaataactctccagaaactgacctgatagaaatagagttacataatttacctaagagagaattcaaaagagctgtcatagaggcttaccaaggtcaatgtaacaatggatgaacaaggtgacaatttcaacaaagagatacaaatattttttaaatgccaacaaaaattaggaagctaaagagtgcaaacatcaaattgaaaaattcactagaggagttcaacaacaggctagatcaagcagaaaaaaaaaaggatttgcaaatgctaagacaagtcattggaaatgactcaatcagagaacaaaaagagaaaagaatgtaaagaagtttaaaaaaaacttaaaggacttatatgcattatgggtgttaaagaagaagagagaaagaaaggaccagaaagttattcaaagaaataataactgaaaactttccaaacctggagaaggaaatggacatctagatccaagataccaaaaagtaacaagtaaaatgaactcctaaaattctagcaccaataaacattaaaatcaaattgtcaaaagtcaaagacaaatagttttgaaagtatcaagagaaaaacaactggttacatacaagggaattccttgtatgtaaaaaacaactggttacatacaagtgtgagtggatttttagcagaaaccttacaggccataagggaatggaagagggaaaaataaataaataaaactaccaatcaagattactatgcctggcaaaactgttatctaaaaaaatagaagacaaaaaagatgttttcagacaaaaataaagcagtgtattcgtcaccactaaacctgtcacataagaaattttaaaggagttcttcaagttgaaataaaaggacactaaatagcaatacaatacaatacaaaacagcacatgaaaattatgaagctcattggtaaaggtaagtatgtaaacatacagaatactgtattactgtaatggtagtgagtaagtcacttttaattcaaaaataaaacttaaaagataaattattacaaataaatataagtaaatatatgtttaaaaatacagagtaaaaacaaatggaaattatgacaataaacaaagtgtggggggagaagttaaagtgcagagtttttacatgtcattaaacttaagttgttatcagcttaaattagactcttatgtctatgtcttgtgtaagctccaaggtaaacacaaaaaattaaattatagaacttacacaaaagaaaaacagaaacaaatcaaagcatatcagtacaaaaataaatagtaaaacacaaaggaaaacagttaatgaagaaaatgcagtcaaaagaactatagtactaaaataaaacaactaacaaactagcaatagtaaacccttcactatcaatacttagcttaatcaaaacgcattgagtggctgagtggatttttttaaaaagaacagagaaaaacatgacctcaactcaagtgaggggaaaatcatttgagatttaagggcacacataggcttaaaattaatgaatggagaaaaacagttcatgcaaatggtaaccaaaagaaagcaggagtggttatacttacatgagataacactgactttaacttaaaaactgccaaaagagaccaagaagcaccttgcataatgattagaggaataatcaatatatttacataataaatatatatgatatacctaatatcagagcacctaaataagtaaagcacaccttgacagaactgagaggagaaacagacaacagtacaataacagtaagagatttcaattctccacttttgatgccggacagaactctaggcagaagatcaataaggaaaccaaggacttaacaccacaggccaaatgagtctaatggacatatatagaacattccatccaacaacagtagatacgtgttcatcccaaatgcacacagatatttcttcaagatagatcatacatcagatttacaaaccaagtctcagcaaaattaagaaaattgaaattatactaaatatattttcagaccacaaacagatgaaactggaaactaatattaggagaaaaatttaaaacttcataaaaacataaaaattacacaaaacattcttgaacaacaataggtcaaaagaagaattttttaaaaaattatgtaatactgcaaggcagatgaaaacaaagatacgatatacaaaaacttatgggatgcagcaatagtaagtaatactaagaggaaagttcatagtgataaatgcatacactaaaaacaagaaggaagattacaaataaacaatttaattttacacctctaggagttagaaaaagaagaacaaatcaagcccaggtttagctaggcaaaaacaaacaaacaaacaaaaaaaccaaaaaaaaaaaaacacaaagattagagcagaaataaacaaaatagaaaaacggtagaaataaattaatgaaactaagaattgccttttttaaaaaagataaccaaaattaacaaattcttaactaaactacttaagggaaaaaatgacaagactcaaatatataaaatcataattgaaagaagagagtttacatctggcaccatttaaaataaaaaagaacatgaaagactactatgaacaattaagcgccaattaatcggataagctagaggaaattcatacatttctaggaacatacaaagtaccacaactaagccatgaagaaatagcctaaacagacccataactagtatgaagattgaaccagtaatcataaatctcccaacaaagaaaagcccaggtccagatggcttcacaggtaaattctaccaaacatggaaataattaaggccaatctttctcaaactcttctaaaaaattaaaacgaggaaacacttctaaactgtttttatgaggccagcattaccctgatactaaagcagacaaataaacaccacaggaaaagaaaactataggccaatattcctgatcaatatagatgcaaaaatcctcaacaaaatgttagcaaaccaaattggacagcatattcaaagcatcatgcaccacaaccaagtggaatttaatctgtgaaaataaattaatgtgatacacaaaatcaatggaataaaggataaaaatcacatgattatctcaatagatgccgagaatgtgttggacaaaatgtaatgtcctttcgtgataaatactctcaacacagtattccttctaagaaaagaaggaaaatatatcaacatgataaaagtcatatatgaaaagcctacagctaacatcatatataatggtgaaaaactaaaagtgtttttctctaaattcaggaacaagtcaggcatagctattctcactccttctatttaaaatagtcctggaggttgtataacagcaagagaaattagacaagaaaaaaggtttaaaaaacatccaaattggaaaggaagagacaaaattataactgtttggagactatgtgatctcgtatataggaaatcccaaagattccttaaataaattaataaacaaattctgtaaagttgcaggatggaaaatcaacatacaaaatgtagttgtgtttgtatatactaaaaataaactatcttaaaaagaaattaggaaatcaatctcatttacaataacatcaaaaaattgaaatacttgggaataaacttaactatagaggtgaaaaatttttacattaaaaactacaaaagatcgataaatgaaattcaataagacccaaacaaatagaaaaacaccccattcttgtggattggaagacaatattgttaaaatgtccatactacccaaaataatctacagttttaatgcaattcctatcaaaatatcagagacttttctacagaaatagaaaaagaaaacaattctacaattcatatagaactacaaaatactaggaatagaccaatcaatcctgagaaagaataaagctggaggtatcacacttcttgatttcaaaatattttatgaagccatagtaatcaaaactgtatggtactggcatttaaaaagccatacagcccaatggaacagaataaagaacccagaaataaattcacatacatagtcaattgatcttcaacaagggtgccaagaatataccatggatagaggacactcttatctatcaaggctgttgggaaaactggatatccacatatagaagaatgaaattggacccttactttacagcatacacaaaaccaactcaaaatggtttaaagacttaaacagaagacatgagactgtaaaacttctagaaaaaaagacatgggaaaaaatcttcatgacagtggtcttggcaataatttcattgatataacaccaaaagcacaggcaacaggtgggggctatatccaactaaaaagcaaagcaaaggaatctatcaatcacataaacaggcaaccaagggagtgagagaaaatatctgcaaccattatgtccagtaagggttaatctctaaaaatattaatatgtaaagaactcgtacaactcaataccaaaaaaaaaaaaagcatgatttaaaaatgggctaaatacttgaatagccatttctccaaagaagacatacaaatggccaacagatacatgaaaagaggttcagcactaatcaccagggaaatgcaaatttaaaccacaatgaggtatcaccttacataccagaaatgggtattatacaatttttttaaaataaatatttgtgaggatgtgggggatttggaacccttgcttactattggtgggaatgcaaaatggtacagctgctatgaaaaacaatatagaggttcctcaaaaaataagaaatagaactactacattattcataatctcatttctgagtatatattcaaaagaattgaggtccatatctcaaagagatataaacacttccttgttcattgcagcactattcacgatagctaagatgtggaaacaacctaaacacccactgatggatgagtggctaaagacaacgtggtgtatgtgtatgatagaatagtactcagagttacaaaaaggaaactctgcaatatgtgacaggatggatggaccttgaggactttatgctaagtaaaataagctagacacagaaagacaaatactgcatgatcccacttatatgagatatctgagtagtcaaattcatcaaagcaaacactgcaatggtggttactggaagctaaggtatattagtcagggttctccagagggacaaaagtaataggatatatgtgtatatgaaagggagtttattagggagagttggctcacacaatcacaaggcgaagtcccatgataggccgtctgacaggtggggaagaaagaagccagtagtgtctcagttcaaaagtctcaaaagcagggaagcagacagagcagccttcagtctgtggctgaaggcccgagaccccccagcaaaccactggtgttaagtcccagagtccaaaggccaaagaacctgaagtcttatgtccaaaggcaggaagcatccagcatgggagaacgatgaaagccagaagactcagcaaggcagcttatcccaccttcttccacctactcttctagccaggctggcagccgaatggatggtgcccacccacattgaagatgtgtcttcctctcccttttcaatgacttacatgtcggtctcccctggcaacaccctcacagacacaaagagaagcagcattttaccagctatctggagatacttcaatccaattgagttgacacctaatattaaccatcatgtaagagaagggaaaatggggagttattgatcaacatgcctaaagtatatatcctctctctctctctctaaatatatatatatatatatatatatatatatatatatatatatatatactctctttcctgcctattcccctgagttctttcagtatatttaaataatttttcatgcacacatatgtataaaacatattatgtgttttttatttactattatttcccctgcttcttttttgagactgttaatttataaaacttttaacatgtaattatctttctacttacttgaatttactagtttaaagataatgcattttattcccattattttaagggctacctttaagtattttagtctgcatgtacaattacattcatggtatttaataattgcattaaagaaaatcagcatatcctgcctgctcctgaagatgaggaccttagtaaaccctcatgtcctcacaaactttcccctcaaaacatcctctcctagcatctctttgaatattttcatgtcattgtgatctagagcaggggtcagcaatgttcctgtaaagggccaaacgaaaatattttgggcttcaaaggccatgtgacttctactacagctattcaactctgctgttgaaacatgaaaatagccagaaacaattgtaaaatgtatgaatgtgactgtatttcagtgaaactttatttagtaaagcaaagaaagccagatttggcctgtggcatacagtttattgaacccgttatttatgaattttgattcaggtatttttaatgtgaaaataataattatgtttatgattataataaatttttagaattgcccttagtttactgatttcttctttcacctctgctactgaaatcccatttctttcacctggattcattagcttttcggtttttttttttcactgaatgcatcatttaggatcaaggcctctgggtggtgaaatttgtcatttcttttatgatttaagatgtttgtattttatcctccctcttaattgatattaaagctgggtatagaattataaattggttgttttcattgcaatagaccattgtattagggagtctattgctgctgctaagaaatctgctcagtgtcacttatttgcaggtaatctaacttttctctctgatagttttaaagattttctatgacagcctacaaatttcctcattctcattacgtctaggactatattgaagtttaatttttatattttacttctcttgttcagcattcaatgaggctaccccctactgccacattatgaagattgaagtttttccttaattctgaagaattcttagccattatctcctgaaatattttttctctcccattttctctatatctttcttcaaggatgcctctctgttatgtaagtgacacaagtgtatgacttgtctaggcctgccagagaatgggtagcttaaacaacaaacatttattttctcacagttctagaggctacaagtctgagatgaaagtgtcagcagagttgattgcttcggaagcctttcacgttggcttgttgatggccatcttctccctgcgcctcatggatatctgtgtcctaatttcctcttcttatgaggacacggagcatattgaactagggcgtttcctaatggcctcattttaactttgattacctctttatagatgttaccttcaaatacagccactttctgaggcactgggggttagaacttaaatttgcaaatttgaggtggggaggatgcatgggcatagtcagccccgaccgcaggcgagtgccgaacctgccccgctgcctgccccatgcctttcccactgcacggatttcatctcctgtatctgcacatttaccattggcgatccataatggctttcctcctgcttttcagcatagctatttatttttagtattaaagatgtttttgtatatcacaacatatttctttattcactctgctatgaattaaaatccatgattttattttttcaaggaacatacaatttttgtatcttattcattactttttaaataaatggattttaatggcagctgcgttagtttcacagggctaccatcatacaccactacaaactgggtagcttaaaataacggaaatgtattctctcacagttgtcaaggctagaagtctaaaatccaggtgttggcaggaccattcttctctgaggttccaggaagaaatatttcctcaccctttcccagtttctgcggctgcggccgtccttattgtccttccagtcacacctgcgtcgctgcagtctctgtctctgtcatcactcggcattctttcctctgcgtgtgtctgcatccaaatttctctcttcttataaggacatcagttattggattaggacctaccctaatccagtatagttatgtctgcaaagaccctgtttccaaataaagtcatatactgaggttctgaggtagacaaattctggggagaacttttcaacccagtacagctatctagcattctgtacaacggagatgattcatttaattgattcataaacagtggaaatataggtttcttccagattttttcccttctattaataacatgacagtaaacaaccttgtataagggactttgtgtatgttactgattatttccttaggataagcttctggtgatgaaattacgtgattaatgctgttacttttaggttttgtatccatctatatgtcttggtatttgcacacccatgacatacgttttggtgcttaataggaaagttttttttttcaccttgactaatcaaacacacacacacacacgcgcgcgcgcgcacacacacacacacacagatctattcggtccagggacccctttctattttcaacattagctgctgagttactctcacacccgcacttcctaattatgttgccattttcccaggcttctgtctgtgaatggcacatacatgaccaaagtcaaacaatttgcaacaactgttctgtgcaacaccaggcccactcctagagccttagttacccggactgtcatctcagacctaagcttttcagctgcctccaatgcaacctcagaatgacaagtgatctttctaaaggatagatcagatagaatctacctctgaatcgaacattaaaataaataaaagtaaaacattacccaattctctctccaactccaaatgatttttcattgtccttaagataaaaatccattttattaaacataattttcaaggccttttatgaccttgcctccccctgcccgagcaatataatagctttatgatatgagccataaccatatctgactacttacatttccctattgtggagacctatctagttgtcccttgagctcactgtgttttccactttcataacaaattcaccatccctccacctctctcccggatcccctgaccttgtgacatggtgacaaaaggagcaataggagaaccatgtttattcaatatgacttttatcctgtagcacagtttagaggaccacaggtacttcctgatctgggttagaccaataacctcatttctaaaaatttgaaatcagctgattgcaatgatgagcgtggcaactcagttgctgttggcattggttaatttttcaccatgagaactgggaagcgataaaagctttttcccactagagagaaaaagaagtattcagtgaggagtagaggcaaggggtggtgagcaggaggactgtctgtgtccttactgtactcatgttcctgctcccaatgcatgattgaggccactctgtttctgcctgtagaatctatactgtcatcctatatccttattttaaaagtctcctttttgcattaacttattccagtagtcattctgcaggaaaaaaaaaaaaaacctaactgatgttgatgttgttgccgtatgcaccgtgttctctttctccttgggttctgtgcatgctggtctctgtgcctgggattctgtcttcatccaatatccttcatcactatcccagtttcactcctgtactacctacttatttttgcatctcgacttagacatggctttattttagatcttttgacattttaagattggttaggtttctccactgtgcttttatagcacttgttttcaaactctgtgaagacacctcgcagtgataaacagaaaatgcagcatgatgttctgcccagcagcacaaaagctctttgtgggattgtttcacccaaaattatcacaatacctggaacaaagtggtctctcaacagaaattattgttgcaaattgaataactcatttgagaaagctcacacatttccaagtgactgtatcttagatctcataataatttggaacattttaacccagtaagttagtctattagtaagtagcattttctagctgtccacctctctagatgtactgttggggtgattcagggcaaaacatgtataaaaagagctgtgctgaaagagtagagctgacaacaagtaagtatccagatgtcttccttctctatgttgtgctcataaagccaaacaatttcaaacttcaagccctgcattagatgctctagcttccttaattatacatatacaacagtatggtttgaattgggaccaaagatttcataaaagattaaacagaaaaagaaaagaaaaggtttttagtttcttgctccaaattcttcataatattctatctttatatttctcctctaccagatatcacctgcagtgcctaacatcatgctttgtaaatattgggggcttaatagatgttaatcagacagagccaaatgggaggttttttttattttgttctgtttttgagacggagtctcgctctgtcacccaggctggagtgcagttgtgcaatctctactcactgcaacctccacctcctgggttcaagcaattctcctgccacagtctctcgagtagctgggactgcaggcgcccgccaccatgcttggctaatttttgtatttttagtagagacagggtttcaccatgttggccaggctagtcttgaactcctgacctcaagtgatctgactgccccagcctcccaaaatgctgggattacaggcttgagccaccgtgcccagtcagatgtttaaaaattagagttgctaaacaggtctaggtaatatgatcaaagaaatgaaagcagaagacacattggttttctatatatctatagaactaaatgcaaagagagcttcttgtaagcattgagaactgtcagtcgcagactggggtggtttgagggccaccagagaattctgtttagctgtagtcaatgtcaagcctgatacatggttgagtccacataagggcctgagcaggagagccgctgaggtaggaatctgggagtggactttggaaatgctggtccctgtgggtccattcatgcactggagtcatgtgaaagctaacgttcgggagaaggtcaaatctgagtacatatgattcccaaattaacattcaagttcaattactagccagaacttggtccaggtgtgggaatttctgtgaagtcaccagcagattttaaaggtaaacagcccaagttgagaaggtgagcatgagcattagtgtttggaaatattggccatattgtaaaagggaaccatgggttagagtaggatctgggaagtaaaggagaagataacctagagaggttcccagaggcaggaacattttttgggagatgcccatgtgatgcttcctatttttgttttttaagggtgcaagtctgacagattgtagagataccgttaagattatttaataacagaaggcttttacagttcttaaagccctttcacttacctcttcttgttggactgtcaccacaacataacaaggtgagatttgccattgttgttccctttttacagatggggaaacagaagttccacaataatgactggcattcccaggaccctattaataagatgaggaggcaagagtagaatgtctgtcttttgtctctgatttacatgttttctgtctaccataccccgttgactttgtccagtctccaggactgtaaaatctactgagctttcctagcatgtttaacacagcatataaaacacatccacagagaccagaattgctgctttttttttaacactgtagaatgcataatgcatgcacacaggggaacactcccttaggagcagtgtaaatgaatgccttcacatcacatcattttggaagcctactttctaagcgcctgtcacactcattagagaaccttaggaggtacagtaggattacttcctcagtataatcagtttatgcggagctccagaaatggcaacctccactagtcagtcagtgaacagtatttactgagcccttcttgcataagaaaaatgatggagagattcagaagaaataagagatgtgttctctgattgctgagaactgacaatctgggaagaatcaccaaaacttgcccctcttgtagagtgatgttaaagtgtgctgttgtggaaggaagcggttaggtctcccagcctggctccagtagtctctggacactgtcaagtgccacctcagcaggagctgtgtctctcacgcacttcatttcataagataattgagtaatagagggagagtatcttggctcttggagactttattgcttaaaaaccaagggccacaatggccagggtgaccaggccaagagagccccagactcaagatcaatcgggagagcaggcgtcactgaaccagaacatcatcaactttccacgtgatttttgtcagatggcttcatgctgctcagcctcacttttctcacccataaaagggaccagtgagttgatgttctttaggtatgcaacgctgagagtccccttcttcacatggcagtggttgaccagtgtgttgtccagggcatggctatctggaatcaacagcattttggggcaaaatcagcattttggaggtaaatcttgcaacatctcctccacctccaccaaaaaaagtctcactgattaaaaaaatgctgtcagtgaagtttttctgtttttttgttgttgttgttttcgttgtttttttaataacgtaaaagtggacaataatacataagtgctttcaaagaaacttgtaaaaatggcttctgcagatcccattcatagaggatatgtggacactgaaaggaaatttcttcagtcaagtgagtctaattatgggaggaaaaggtgaaataaaaaaatagttgaggcaaaatttgtataacatagaattaaccaatttaaaatgaacaattaatatagtgacatttagtacattcccagtgttgggcaaccaccacctctatctagttgcaaaacatttccatcagcccgtccaaaagcccattcccatgaatgagcttctccccaaagagaaggtgaattgtgcaagagtcaacagcaacaaacccagagacattcggggagaagtaaggcacccaaatacagaaacatacacacacctctttctcactcacacttatagatgcaaatttaacatggagtctttatactccaagtatcacagcactgtcttgtcccacagcataacagagtgataataagcacacactctgaggtcaaactccctggctgcagatcctaagtccattattgactggctgcataagcctcatctctagcatgagggtaataacatatatctcaggggtgttaacgatggcttaaattaataatgtgcataagcatttatcttaatgaacagaaaaaattagctatgaccaacaaaaggtggactgtgtgccactgaagaggagaggtagatgttttctctatactactgaaaagcagcaaagtgaatacagaacacaacaaggtttatggagtaacattgcctattaatgtcttactgacctctatctacacttgctgagctcagtgtacgttcagagattctagaggcatttccagtgtatacatcagtgtacatcactggtggcatttgagctttgcctgctttttattttaatgttagccaatttgtttaaatttgctcagcctgagtcaagttattagccctatgatgaaatgcaccccccaacccaaaggtctcccagatagcatcgttctgcttggataacttcctgccaggacccacccacatcaaaagttcctgctgtgtaggtcatggtttccttcctctcagtcctctttatttctccctcatatatcctcaggcacactggggtattaaacacacaagataatcttgagatgtaacctatatataaatcaaaaatagcataggcatgtagttttggctttgccatcagttgcagttctgctttataattctaacccagagcttgtttttcattgttctggactagtagaaaagaaatttcttcagtttggttcacagattccctcttagtcataaaaatgtcaagagccactctacttgaagctacccaaatgccaacaaacgactcctctgggttatacccctgattttttcatactagactttttttttttcctgagacccctactttccaaatagtgctttacaggagacctatgtgcctctacttttttaatctatcatttttgtagaagctttaagtaattatagatcttgctctgaaaacaccagtttctagtgcctcagttctttaatttggcgggacctgtgttgccaggccctcattttggagtgctaatcatctgttctcaaacaagaacacatattacaactcaaatacattcctctctgactctgctcagtcagtgctttcaactcatgcataactagggagaaaggaaatttactgcaaactccttcaagaattatctttaaccctggaagccttcagttcggtctaatacaagtatggctcttttgtaactctccttctgtcaaagaattgctgagaatgtggctgtatggacactaggctagaggctccacagcctagaaagttcaattggaaaggtgaatctgctgcaaactggatcataatttggtttaaacattaatgtcaacacatgtatttggttgctcacaggcctgttctcctgtgccatcgttgtccactgagttacaagtgatgtttaacagttatgtctctttctaagtaagctcatcattcagaatttaaattcacagaaatgattaagtatgacatgaattcattttacagtgaagccctaaagttgaatgattttcacagtggattggagcagcagccatatggtcccccagcattgtgtgctaatgaatctcagctactggccaacaataggcatttattgagggcctcttgtcccaggccctggaccaggccctgaaaagaccacaccgtcaaggagcccacactgagtggggatggcagacaaacatggtgtcaggggcacatgtgggagcagagcagctgatgagtcagtggagacaggcaggggccaactggaaagggttttatcatcctaaagagcctatggaggagatgaggacccaggaaaggattttaagaagcacaacttaatagtggcttagaaatagggctttctcatcaatgtggaagatggagtagagggatctcaaggcagcaagccaggtagcaggtagttggagtagttcacttaagacagggtaagagccaaaatgaagatcatcatagtgaagatgaagtggaatggggacatacacgtcatttcagataatgaatattgtcaagaagtagtgactttttgagtgttggtattaagttaggagaagtctaaattgacttccaagtttcagatttgagtgagaagggcctggaaccacaacaattctaggagataacatcagaaaaactcttctagacactggcttatgcaaagtcttcatgaccaagaacccaaaggcaaatgcaacaaaaacaaagataaatagataggacttaattaaacgcaacagcttctgcacagcaaaagaaataatcagcaaagttaacagacaacccacagagtgggagaaaatcttcacaatgtatacatctgacaaacaactaacaaccagaatgtacaaagaactcaagaaaaaaacaatcccatcaaaaagtgggctaagaacatgaatagacagttctcaagggaagatatacaaatggccaccaagcatatggaaaaatgctccacgtcactaacgatcagggaaatgtaaatcaaaaccacaatgtgataccaccttactcctacaagaatggccataatcaaaaatcctttgttctcactcataaatgggagctaaactatgagaaaacaaagatgtatgaatgatacaatggactttggggacttgtgggaaagggtggtgtccaggtgaggaataaaagactacacattgggtactgtgcacactgcttgggtgatggatgcaccaaaatctcagaaatgatcactaaagaacttgttcatataaccaaacatcacctgttacccaaaaacatattgaaataaaaagtaagttttaaaaataagtaattagatactggggtgtgtggaaaactattagattttgatttttgatattactaagaatttgatataactgtgagacctgtaactttatagacaaatggaaaaagataaccaagtcctgaaagttgcatgtgtggagtcacaattactgaccccaagtcatggtagagatttctattacctagggaatggcaaaaagggaagatctgagaacaatggtaatattggcattgacattttaacatttcccacaataggcacatacaaagtatcaattgattcaaatctatattttatacatgtataatttgtgggaaatgactaagttcacataaattttttactcacacagagtgaggctatagataaattatggcttttatataaagtgagggatacttgtaaaatagcttttgccaattctttcctgaagcttcaaagcctcttaaatggctccaatcaaaggtcacagtctggttttaaaaccaggaggcatatgctgtcttctgtgggttttagcacaaacttcagagctgcagccaaggacgagagtggcactaggaggaacaggacatttatccctccaggtggtcatatattgttgttttcttttcgtcttatcttcttgaaataatctcttctctctttacgagttgacacatggggtgaagtttccctcatgtgttaatgtaatctctgaaggagtagagttccctttcattccatttttattaatttgtttctcataattccagtgatgtgtttggagtggaaaaaattgaagagaaaaaagaaaaagaagtactaataaaaagcagaatgccccccagcggcaagctggtggcgtccagaggttgcagataatggattagcttttacctatttccatagcaacagcttagctgctcttaaacacttccttaaaagcttctgataaatgtatcctgtgaccctgaaaacttttccatctccctcctgacttctttcatcttccacccctccttttcccttttgccccacaaaaacatcaattattacccataaccttgtagcatttgcttggttttctgcagacctgcttcctttaagggcccaagatagatttgacagtgggagaccgagaatgctgcatgttctccttcctccctttggctcctctctccctctctttcccctccccttcttgcttctctctccctctcactcttttcttctttgtcctttttctctctccccttgcctctttcttattttttttagtttgttctttctcccatttctcaaactaaatatacatggaagtcatcattctatggatcactgattggaactgaattgacaattcccaatcaaatagttgaaaatattaattgagcgcttgctggtggtcagccatgagctgtgctctggttgggatgggggcacatgaatggaataacatcaagagtctagaagagtgcccttgcccatatcacccacatagaaatcaagattctggctgaaaaaattgaacggtcaacaattatgcaatcatcaacagaatcagggtaaagaataggttaggattgtaaagatgggacttttgttcctggcagccactgctatgccatttagaatgatcacttatggttagatcagctgtatttgtattttagtctgttaaatgaggaggatacaatcataaaagaggtattatgagaatacaaaactcaaacaggatggttcatatagatgaacttgtattccacagaggtaaacttgttgttcttgttactggcttaatatccacaagaagacaaagacgaagacgaagaagaagagaagaagaaaacggggcggggggaggaggggaggaggaggagtggaggaggacaggatggggaggacgagtaggggaagaggaggggaggaggggaggaggaggaggggagaaggggaagaggaggagggggagaggggaggaggggaagaggaggaggagggggagaggggaggagggggagaggaggagggggggagaggggaggagggggagaggaggaggggagaagaggaagaggaagaaggtgaagaagaggagaaggaagaggaagaagaagaagaagaaaaagaggaagaagaaaaagagaaaggaaaagaggaagaagaagaaatcagaatttttatggagaaggggaaaactgaagctgggtatgaagagatgaaggtctaaatataggaaagggagaaagaactctcctatcagggaagatgaaagaggctggtacccactcttcaatgcatctcctctaactactcacatgccctacacatagtagggactaagtaacaccgtgtgtgtatgtgtgagcatgtgtgtcttcctttttgtctcatttgttccacctgatagaagacattgttttttcaaaagatgagtaagagaagattttaaaataaattaaagcacattatctataaatacctctaaaagaccacaatgttgcatcttctgcagagccttttctgactctcctggtgcccatccacccctgctattttgcccatcaccctgtgtgtacttatcaccttctcatgcagatagtgcaactcaatgccggtgttgaaccttattcgtctttattacttcagtgcctggcaaagtgcctagaatatagggaagtgctcaggtactgttttttgaataaagacacaatttaatgagtgtcatgaatcaggcaatgttaactaagaaagctttcttgaagaggcgaactttggaatggattattaataaaggaaaggacgggattcaaataggcatgggagccatggcccttcattggacagcccactaaagatatcatggtagcccaggcatcctcaagcatcccattttccagagcaggggggttgggcaccgacagagtaaggcttctccccttccaactgcagggttaatcaaggaagaaagaaaaccaagtcgtaatatcctaattctcaactgagcgaacagaaatacctctttcacttatttctaagggacgtgatacctctgactccctctacgactgaggagaaaggaccttggaatccaccactgtcaatcggctctgggtacagaatctaaattggtttctggctcccacggacataatctggcactttccctgagcactgtatttaataacaacagttgcaaaggcaataaaagaggtaaaaatggtattgttattttattattactttgtctccattcttttcatagatacccagtcaactagggtaagaataagatttttttcttgtaatatcctgctccataaaagcaatttcacacataaaattggaaactcattttcagccaggaacacgggcctaagtacacacatattttgtgagaaagagtcagaactctcttcctcatgggtttcaaaatgataaaattccaggttcagggtactttggaagacaaagtggagtttaatatccgcctaggagagtccaggcccaactagagtcacacttctcttttcctgcagtacttggtgcaggtaagtgtaatatcaggagtaggtttggagaggaagtggaggctataacagccatcatatagcagagggtacagtgtgcaccaggccagccgagggtgagtgttctggaaggagaaagtggcagcctctctgacctcctcttaatgcagtgggaaacgtatgctgtgaacttcaagtctgtttgcatgaattggaagacctgtttcactctcacattcctaggaagtttctgcaagctgccagaagctacttgatgagctgagattccacacactctcctgtttgtgtgacctttggaaagtgtcttctctctggaccccaatttcctcatttgtaggatgaggaagttgtgtcatgaggcaaattctaacgtctcttgtagctctaaaattttatgattccataattagaagcaaacaccctgaatgttttgaagatctttgggtaggcttgccattccaggagaaaaaaatcaagtaagatagacccctatttcttataaatgatcttaagttcatcttagaattaatatgttctggttcccttactataaagaacaacaatttttggtcaggcacagtggctcacacttgtgatcccaacactttgggaggccaaggcaggaggattgcttgagcccagaagtttgagaccagcctgggcaacacagcaatatcctatctctacaaaatttttttttctaaattagctgggtgtgttcgtgcacacctgtagacgcagctacttcagaggctgaggcaggaggattacttgagcccaggaggtcgaggctgcagtgggccatgatcacaccacttcactccagccttggtgacagaaggagaccctgtctcaaaaaaaaaatccaaaatttttattgaaacaagaaacgttttgatataatcctttgaagttctttatactctctttgtaaagagatcatcctttgttgatctcacttcacaagtgctctgtgaccttacacacaggtacagagttcatgttaagatcacaaaagccattatttgttcagaccagtgctacatgggcccagaattctgattaacagtgagcaaaatggatgaagggggcatggttgctcactatctcatcctcagaagtctacgcgccttcattcatcccctcctttcttcagacttgagggtttgtcaagccattccagagactgaaaaatctctgaaaatgaatctaaattaatttagattggctggttcccctttgatatggtttggctatgaccccacccaaatctcatcttgaattgtagctcccataattcccatgtgttgtgggagggacctggtgggagataattgaattatgggagcagtttctcccatattgtttttgtggtagtgaataagtctcatgggatctgatggttttataaggagaaacccctttcacttggttctcattctctctcatctgcttccatgttctcattctctctcacctgctgccgtgtaagatgtgccttttcctactgccatgattgtgaggcctccccagccatgtggaactgagtccattaaacctctttttctttataaatcacccagtcttgagtctgtctttatcaacagcatgaaacagatgaatacacccttaatcaaaaaaatgcatgtttctctctaggaaatctaacagacttatcagacatgattttcccttgtggttgcagcatccttcccctactgtctcagagggaatcatgctggtcttcatcacgcagtgctcccgccattttcccatggatctcttgacattatggactctctaagtgtgcatcctaaggactttttaggatagtgttctcatcagagaaaatgccccaaacagaaactttcagaaactctacgtctcagatctaggtctatctaaccatagagctaatgaaaaaaaaaaaaaaaaaaaaaaaaaaaactttaccccattcccatggcttttatttactttttattttcagtggatgctatttgcaatgaaagaaaagctctgtgagttaataacataaacacatggaaagagccttcatagggtcctcctttgtattaggcaaactcctaagctaaggctcagaacattggaaagcctagtgaattgcaaacctcaatgtgacagtgaaagctctggcctggtagactggagacagggcaccatgagctgagacaccccagcaggtggggtggtacctgcagagctgagaatgtccccactgtcctcagcaaagctcatccaggccaacttgttttgtgaccagtcatggctcttctgacaaagggaagatttacaagtgtgtccctgatgctcagcagctagctggcttctgaatgctttggcaaaaacttgctggaaatggtttcattttctcctgccctgagacccattctgtccctgacagactttgatttgacacagtatagaagggcaaataccaggcttgtgccaggggctgaggcctttagggcgatgtgggagccaactaaagattttgtagttttggcctacagtctgcactcaaattaaaaccagataaactttataaacacagtttgatggctgtggaacagcagactgacatggggtgaaggaaatcggaatttgcctgataatttgtctgtcagagtggaagaggggagcagtctcatcctcacgtttaatgatctaaatctcaggtcccagcgtgttctcctttgctctaacttctgcaggccccaggaatttccaggcaggcagagcatttcccagaaaggtccctggcaggcaggctttccattggccagctcctcatcactcctggggttcagcaaagatgataaagggcacaaaattgggaaagaagggaaggaggctttggctcatggtttccaaattaatatcttttctcttctcattttgcattcaaaaccaaacacagtagatccaattcagcttcaggcactttcatctgtgaagtcagattggcagagtttgggaagggagaatatgggggaatccggggaaaacgtacaggaatgcattattcattccgcattatcagataatgagatgttccgaatgagtgaatattctagataactgaatcttcctttctaaacattcaaacttcctctacattttagaatatatttatgtattttgttaaaagtgttataagaatctctgcctagaatacctgattataattagccatatcttgcctacttatcctattttaaagagaaattaattttatttctctgcctcacagagatgcactcagctatgcccttctgtggcccagcagttccaagctctttctcctggtgtgcatgcacactcttccttgtgggggtcacttgtcggtacactggggcttatagcacactctccctttctttttctaatcttttgtacacaccgacttaggagtaaatggctgtctccagggaaaggcaaacagccatgcctattaaatcagcaactttatttcctacatgattctaagtccaccattcagttctgatccataagccacgatccatctgttaagtgaagatgctgtgcttggtacctgggattataaaaagtgcccttgagtggttatcccccattatgggagatgactgatgcttcccatttatcagggctgtcatttgggtaaagaccgtaagttgaattcattgtgtgaagcacatcaatagcggaaagcacagggtggagaagaagaatagtgtttaattcggctgcgcgtagtggctcatgactgtaatcccagcactttgggaggccaaggtgggtggatcacgaggtcaggagattgagaccatcctggctaacactgtgaaacaccgtatctactaaaaatacaaaaattagccaggcatggtggcgggcacctgtagtcccagttactcgggaggctgaggcaggagaatggtgtgaactgggaggtggagcttgcagtgagccaagatcgtgccactgcactccagcctgggagacagagcgagactccactcggtctcaaaaaaaaaaaaaaaagagtagtgtttaatttagtttgactagagaaggtccaagatgctttagacaggaaacgatacctaaaacaggtttaacaggatgaataggagtttcctaagtggaaagaaagtagataaatatgttctagacgcagggaataatagctatgtccataagtttaggaatactgaaggttatctccatatgtctctgagaaataaacacatgcattgggtgatggcattatttgttgccttcaaaaaacgtcaaacaaaacaaacaaacaataacaacagaacttcttgttttgtgaaaataaaagcaagtgattgaagttgttactcagtaccaacctacagataaatatggggaacactggagaaggaaagagggatcaactccataaaggaagaacattttcacttttcagtgtcctgtttccttctccggtggcaaagtctgtcacatgaatgggggagaggtctcatgtaatgtcttaccagtcttaacaagggtgcaccttgctgcttactttatttattgatttattttaataaagtggttttcaaaaggtggttcccaaaacggcagcatcagcattacttgggaacatagaaatggaaataaccaggccccactaaaaacctactaaagttagaaactgaggcagggccttgtaatctgtttttacagctcttctagtgactgagaagctcactcacatttgcgaacaagtgctctgacaacatagagaatgggacccagactcagatggaaaccctgaaaaatcaaaatcggaattgaggggagcacagacaaagatatttgttgccactctgtaactgcccaatgggttccccttgcccactgcctagacagagccaatttatcaagacaggggaattgcaagagagaaagagtaattcacgcagagccggctgtgcaggaaaccagagttttattattactcaaatcggtctcctcaggcattcagggatcagagtttttaaggataatttggtgggtgggagaaggccagtgagttgagagtgctgacaaattgtgtcgaagatgaaatcatagggaattaaaactgtcttcttgcgctgagtcagttcctgggtggaggggctacaagatcagatgagccagctgatcaaactgggtggtgccagctgatccatcaaatgcagggtttgcaaaatatctaaagcactgatcttaagagcagtttagggagggtcagaatcttgtagcctccagccgtgagactcctaaaccataatttctaatcttgtggctaatttgttagtactacaaaggcagtctagtccccaggcaagaaagggatttgccctgggaaaggcctgttatcatctttgttttcaactataaactaagcccctccccaagttagttcagcctatgcccaggcatgaacaaggacagcttggaggttagaagccagatggagttgcttaggttagatctctttcactgtctcaattacaattttgcaatgacggtttcaactccaccctatttcctaattctagcgtacgtggtctggctgaccaatcacatcggggcacagacagcttcttagtgttgctggggtggcccttggttctgaaagttcaagacaggggaattgcaatagagaaagagtaactcacagaactctattttgtgctgcactgagaaagggcccatctctctggaagcctcagggtaaggcgcatccaggaaataaacatggaaattcagtggtgctttactgatttgtaaatgagccagattcactgcatgatagcccaggagttcctccattggtccatttccttcccatccaaagtctaaatcaaaaaataaattttaactagaaggtagcagaattcaggcaaaggggacatcatggtcctgttcaaatgtttcctggcatgcacatattatggcataatccacccagttcacaaatattctttctgccatagaaaccaggcaggtggagtgtagagttggggactcaggttcctctggcagtagtgggtgaaaaccgtcccttcctcttctcagacacatgctctgtgcttccagatagattccctgctaacagactgagtcaggctttattagagatgccctcttaggccattcttgtgttgctataaagaaatgcctgagacttggtaatttataaagaaaagaagtttagttggttgatggttctgcaggctgtgcagggagtatggcattgacattgcttgctttttggggaggcctcagagagcttttactcatgggggaaggcaaagcccgagcacttcacgtggccagagcaggagcaagagagagacagagggagtcacacacttttgtacaaccagatctcgtgagaactcactcactatcatgaggacagcaccgagggaatggcgctaaactattcatgagaaatccacccccatgatccagtcaccgcccaccaggccccacctccaacactggggattacaattcaacatgagatttgggcagggacaaatatatacactattatcacccccttaatgtcacagattacattagcttcagatcttaattgttcctaggagccatttgtgtgtataaggtgagtttgtgtttatatgatctcagctgtcatgttaccagaaagagttccctatccaaaccccaagggagggttcttggacctcatgcaagaaagaattcagggcaagtacacagagtaaagtgaaagtgaagcagctatgttgtctggggtatataccctggggtttgttatcgagcaccaggaaaatgtaggacacggacacacaggaggcacttaggagaagggggtctctgagctgaaagggccagcaggtggcaaatgtgccaaattttatagtcaggtttgaggaggtgggctctgatttacataggactcacagactggttccttcaggtatgatgtttatatagcacatggggaaggctggtcactccaccctaatcttattctgcaaataggttttccagttaattggcgccatcttgtctgcttcttacagtacacttggctgatcaaagagaagggccgcattcacgcgtgcaagctcccagcttgcttgtctatgtctgcagctcgactttacaggctactctttgttagaaaatgatttggggctgcttttcatgaaaaagaaaagccttcccaaggactcccataccctcgctatctgcctaagtgatttcttcttaactcctgtatcaaaagtaagtgtattacgaatgtaaaggaataaaagagtgaccactccattggcagagcagcagcatgggatgtttgactgaatatacttatggttatttcttgattatatgctaagcaaggggtggattattcatgagttttcttaaaaagtggtgaggatttcctggaactgagggttcctcccccttttagaccacatagggtaacttcctgacattgccatagcatttgtaaattaccaaggcgctggccagagtgtcttttagcatgctaatgcattataattagtgtataatgagcagtgagggtgaccagaggtcactttcttcgccatcttggttttggtgagttttggccggcgtctttaccacatcctgttttatcggcgtgatctttatgaactgtgtcaggacctcttatctcatcctgtgtctaagaatgcctaacctcctgggaatgcagcccaggaggtctcgaccacattttacccagcccatgtccaagatggagtcactctggttccaatcttctgacaatcctgggtggcatttattgatcaagttcatgggagtgaggataatattgtctctttgtatacaatttacatatattttacaatatgtctgtattccagttacattagccattacatgaagcagagggttgaagatggagaaaggaaaaggaaagaaaaggagaaagtgacgtggttacagatatgtcaaggaggcacctatctgtcaccatgagagttggttacaggctttagcttgaatttaacttgggtccagccttcaagtagttcacttggtttttgggagttaggtgtctctcccaaaccgggagatcccctgctgtctcttcactttttaacatttaatggggtagaggagagcttattcctcgctggctctgctctgttgccattgtgctaatattgttattttatacgacagtgttaacacctgcttgttgtcttatctaacttttaaatgccatttaattgagagggaaatgagcagatgaacgaaagtgagctgtggtggataagagtaacacccctgccctaggcccatcctcccagggccaggagggtcaccattatctccattctcctttgttctggggcagatataggggggcaggtgccagggagaacatgaattctgtacacatttctaagctagggcaaattcttcaaaatttccactttcctttctgccctacttcctttagagcctactttcttcttctagtctctttagtcccattatccttttactctctgcaccctgcccaccaagctcctatgccttccccaggtaagcttggctggctcataagtcttgatcagtgttggagagggaaagatggtttaaccattctgagtctccacaggcacacacagcccatttataatttaaactctcttgctttgaatcctcccaaatgctgtttctgcttcaggcactctccatagtacagtgtctaactataatgagttttcatcaccttcagaaggaccacagtaggcaccaggtctaagctctcatttttacacccttaggagcagtgatatccattgggaattaatcttgcattgttggagagctcctttgggtctctctccttcactttccaccaatgcacgctgcttgacactgtcaccagtaatgcatgtgttcaaggataaacatgatgtcacgttcagagagatggcaagtggcagacaacattcttgatggagacttttttttcccctccacccccttgatggaggtgttaacttacccacttcaaaaaagttaggagatacctaatttaaggactaaaagaaaaaaataacttccaataaaatgagtggtatgctagcatgctggccttcttcaaagataataaatctgatgagggctttgccactatacttggagtgagatttgtaagttctctagaagtagcacattgctgtctattgggtttggaacctggctgttcacttttccagactctgcctctaccctttctaaaaatctagtcatagccttcttctcctcctactttaacttgcctaaagctccaccaacggtcttcagcatgggtctgctcttccctttctccaagatgcctgcatgccatttactcttgattcgcccaccctctttgtcttagggatagacaaatgaatagttgagaaacaatgaatgcctatgcctcaaggtcagctttctcaccccacttttctgccttgacttatggcatctcccccagttaaactgtagaatttcccagcacttttcaaagagggaagaaggtatttcatcaattttaattcaaataaagtgagtgcctgcttccccactgagtatgtgccaagcatggtttttgcccttgtcatcttgctgtgtcccaaaagcctttgacattttctctggtgacatatttttaaagtggcctttatgtttgcacccaagtttatgagaagtgccagtccacagatgtgtttgtttgcagagactaattattaggctgactcttttgaaatgattgttctctgtctacagcagtggaaggtagggccacacaggctttcctttccctaatgtgtcccatctgtgaggcagcagagagcacctgcggaaatatgcaatgtgcagtgtatgagagcagtcatatttgagcactgtccacctgccaccacccccggcactgtgcttactgctttatatgtactgactcatttaatcctcacaacagtcctactttgtaggtactaattatatgcctatgttatagatgcaaaaaggtgaagtacgaatagcttaagaaactctccaaggtcacacagctgggaaataaatggtagagccaggaaacagacctggctctctctctccagaggccagactctaaacaatagagtaaatgaactttaattgacatatgtggaaagatgatttactaaaaaggatgttggatcatacattctcactcataagtgggagctaagctatgaggatgcaaaggcataagaatgatacaatggactttggggacacgggggaaagggtgggagaagggtgaaggagaaaagactacacattgggtgcagtgtatactacttgggtgatgggtacaccagaatctcagaagtcactaaagaacttattcatgtaaccaaacaccacctgttcccccccaaaacctatggaaattaaaaaatagaaataaataaataaacactttttaaaagggatgttgggaagtctggcaagcccagcaacttctcactgggaagtccctgggcaaaagacataaacagagagttcaccgaagacagtaggaattaccctcacaaaggtgacatgatgtaatcaaaaccatgcagaaataccatttctcacttattgaattggaaaacgtttaaaaatttagttatataagcttctgagaagacttctggggaaacaggttatctcacaggtttttagtggattggaacaatggtaagaccctcatgaaaggaaatctatcagcaatcatcaaaatacagacagatgcatttacattttaagccagtacttattctatgtctctgtagcaaatacacactttacaagtcttgtgggaaattgtaatagcaaaatgttgaatattgaaatcaactcacattctgtggatagggcactagttagataaactatgatacatttatgccaaggaatactacacagctctgaaaaatgtataaggtgtatttctttaaatatgagaacaacagtatatatactctgctacctttgtcttaggaaggatgatgataatatattttcttatttgcttgttttacctaagtacacattggatggataaacaaaatacaaagttatacaaatctgtaggaataaagggatggaaatgataaagttaggagtaaaatttttctgaatatatttttgaaagtagattggtgtttgaattatgttaatgtatcaacttttgaaaagattaaattaaataatttgaaaacaagatattatgtagcttgcagaattgtggggaaggctgagtacctggttgtagcaagtttcctatttactgggaaagagaaaaatatttcgctatgcaaaaataaatgttctccatcaaacctgtcaccatatgccccagatactctgataccaggctatgaaagtaaacttggttattgttccttcctcataataataaatgaagaaaaaatattctttccaaatctcgccacttcacagctccataatcatgttcaagtgtagtgacattaccactatatacctgcttaatgtatcctggagctgcaagactagtgcatagtgggtatttggctcctgtgaaattaaaacaagcaattgttaccctcccccaatcatatgtacgtgacaattacctgcaaagagaggtacataaaaatagacaatgtttaatgaaacaattaaaagtattatttggagatgaatcaaattaagactctggaatgtatgatgagtatgccatgggctaactgggattgtgatttggagaatccctataaaactggaatggggcggtcctttccttctcaaggccatgctcctaccagcttccctgagtacagcgagaaatgttagtgtgtggctccttcctcacctgcctggaggtggcatggtgtgtgcaatgcagaggatactgatttatacaagtgggaaatgacgacccagcttgtcctccttcactgaccctggaggcccagggaaggccagcgaagaggtttttcagcaaaagtggccttcttttgtagttgaaagcactgaacttgaggccactatcataaatatcaatggctttttacctggcatgctggtgaaccttattaacctgaaatattttctgggctggtgacactggagcctctaataactttttagtcggctgcctctgtacttaatgtgttttaaacatttttggcaggactgctttccaaaaagatttgcccaataatttcagcctaagctgtctaaaatattatagaacacttgttgctgggaataatattttccatgataaaatccctgcagcattgtgacatgttaaacattttaaagataattttgtgtatgtctcacctttcaagggaatgggagccttagttcctggtgggcaggtggtgagtaaggagatctgacccctccccagtaaacggtgtgaattattcctttggaagcttccggtgacgttatggtctggagtactgggaagccattttttttttcacgtgctttaattgctttttgctggagccagggatatttatgggtaaggagattgccaagttatttattagatggagtatctagggatagactaatataaatcacttaggccggtattgaatataccagacactcagtaatttaaaaagctttaataaaaatgctaaaatatgagacttgtctttggctgtaatgagactcagttatcatgtttttatcagcaatattcagtcacagacccccctgcctttttcaagagtaagaaaatgtggatataatcctcatttccagactctccaggtttgttggaattgaggaaggttttaaagatttgaaaaaaggcttatataataattatttgggaagctaattgctgacttcttcatgcttagaaatccaagaattataagtaatgtcttttgtggatccagcatgatagtgagtgggggaaaaaacgtggcggtatatatggctaaacttggcttatgtgttgtactttctatattataaagaaccattactgtgtatgctacacccaagccctggtccacagagaacagagtcaaaacctattgtgtttagaaccagtggaatccctaagaactcaaaatgtagtttttaattttttttagtggaaatactaaattaatggtctattctatactatttttttgtttttatttttgtttaattttttttcttttttagagacacttggagacaccgtactccaggctggagtacagtggcacaatcacagctaaccatagccttgaactcttgggttcaagcagttctcctgcctcagtctcccgagtaatcaggactataagcgcatgccaccatgcctggctgtgtgtgtgtgcattttaaagagacagggacttgctacattgcccaggctggtctaaaactcctggtctcaagcaatccttccacattagcctctgaaagtgttgggattacatgtgtgagccaccactcctggttctataccattttatagtttaaaaattatatttacttttatcatatcatttattcacagctagaaccttctgaagatagctctatcatctgcatgccaccaaatactgcttattttaataaaattacccaatggaagaatgatccctgagctcagaccctttcccctcttcccacaatagacaagatgatggacaactgcccatttcttaaacattttccaaatcccatcttcctcccaagataaagagtttctgtatctgttcccagagaatttccttcttcaattctgtcgcagacttgaacacacaatgaccacaacttgggtgcaggggtgaggcacagtgatctaatcttggcagcacaaagctggtgggagaagggaagaggcgtgggtgttcagtcacaggcaggaaatttactgggaagtgtacctaggctgattccagatagatggcctgagggtgaggctgcatcccaaggggcagccagctcagttgagacaccccctgggccccagcattgctactcatgtgagcaaaacacaacagagacctgcagcccattcatcattggaaagctctgggtgtggggggtgagggtggatgttcatggtgcagagcagggcaggagtctgtcaatactcccaagtcgccaggtgccaggttgcaatatggagcaaaccaaggaggctcagagaggttgggtgaatctgtcctgctgatgtggcttccaaaggctgtgctccagacctggatagagactgggtgctatgcagggttctagaataaacttagaagaagggtcatggaagaaaccacatttcccctcaaagatttaggatgggggacaagatggacatgcaaaagtagtttcagaaagccacagcagaaagatctgctggacagtgacaaaatcaggaaggccaggagctgatggagacaaggaggggcatgaaatcctaggtgtggatgcatctggcctaattctcagcccaggcatctttccacgtctgccttccccagccaggagtggcttaaaatgtgacaggactgaggcggaagactggaggcatcagggaccattggtgagaagctgaggagtacaggctggttgatctgggccaggaatgtccctgctcacactccgcactgatcatctgtaaccaaggatcactaaatgacaggtctaggaattaaagcagagaatgagaagatgctggacttcccctgcattgcctcatttggttttcctcctactcagtgcaacaggtgcttttggtatgacctacttctcagatcatcaaagtgagggccacttctgttccaaaccttgcaagacttctcttctacccatctcactgtgtccaaaccaaaagccctgccagcaagagtggagagatgctggcctttgaagccaggcacattggatcacctcaagctgtgggctggctgtagctgaaaccttgggttctgcagtcagtcaatgggagacacatctcagcctctcctcttccaggctgtgtgaaatttagcaagttatttaacccctctctgcttctagtacctaatccttaaaatgtaaagtagtagtaaaactgccatgtagggtttccataagatgaaataagtgatgtgtggcaaactttgcacagtgtcacttgacacttattaagttctcaataaatgagagttgctggcaaaaaaaaaaaaaaaatctggatatagaataaagagcccataacattggcatttactatgtgccagacactgtgacaaaaacccttttatattcatttatcatttattcctcccaatgaccctataagttacttatgatcactatgctgttctgcagtttgagaaactgagattagagaagtcacacaacttgctcaaggtcacactgtgaataagagggagggagctcaggttgttgtaacaagagactgccatgaccatgttaaagaggaaggtagagaaagagagaggtctgaaactcgctccaggaaggccggaaatactcagggggccttcctgtgagagagagacttggattgacagaggtcatgggcttggccaccacctcacagcaaatgcttgacagaactgggactggaaccaaagtacttcctcatgggcaaaatgggaaggtagagcgaggggcatccctaacgtctattttgacttgaaaattctgtgatgtaaattaaaccctgtgatcctaagtgtgtgtgtggccagaagaactctccagggagcctacaagtcgggggggaaaggaacaaaaggagactcccagagggagggcacctccatgctccagaaagaagagaactcgacaagaaagactcttttgctgcattcagttcctctgatcatggtcagttgtctgaattgtgcaaattaaaaataggaagtgtgtgtctgagtctataaataacttctgtaagagacactgtggagacaaccatcacaaatgaacttagcatagcctgagaggtttgtgatgtcacccagcccctggcatgtattcatgtatgtgttattcagaaccatttgttctcattccctatcatttctctcatcaaaatagagcccagaggagaatagcaatcagaatggactgggtctatctgcagcacaaaaataaaaccatatcacaccaggacatggagggagtctcattcacactcagagtatataagaccaaataacatggatctggccctgcctcaaataattggatgtgacttcacacaactcacctagttccaatttgctggctgccccactggatcctgagaggttgtatttttctgaaaatctcctggcattagcaattacatttagcacatattgattgagcacctaccagataccaggcattgtgctgagaggcacctggaatactgagatgaacaaatgacagtccttaattataaggatccccggtcgagtgagtgagagagacatagaaaacaatagaacagtgtgaaaagtgctgtgacactaaccacatatcctgccattcaccaagctctgtttattttactcccaaatgtcactcaaatctctctctttcagctcatctctctcctattactgcacttgtctaaccttctgccatttcacttttggacaactccctagccagtttcattttcacttgctcaacttcagtctattctccacactgcagccaggagtgaacaattcccagtggaaatgtgtcatgcctgcatcacttgccattatcatcattatcatcatcatcatcatcactaccacaatcatcatcaccaacatcaccactatcgtcatcatcagcattaccatcaccaccaccatcatcaccatgatcaccatcactatcttcaccacccttattaccctcaacatcatcatcaccgtcagcatctatcaccatcatcattaccgtcattactattgtcatcactgtcgttatcatcatcaccattatcatcaccatcaccatcattatcaccatcatcatcaccataaccattatcatcaacatcaccattaccaccatcaccataatcaccatcactatctttaccatctttgtcatcatcatcatcaccgttattatcactatcaccatcatcatctatcaccatcactatgtttatcaccacctttatcatcagtaccatgatcttcatcatcatcatcatcagcagcagcagcagcagcagcatgtctttaaacattttaatgtatagcccaactgctgttacaaaaagattgaaaatctcagggtttattcaaagaatctgtaagttctgggctctacctgcgctttcagccttagttcctgagattcactattttcacttcatccacagtcactgaagctcatcatgctctctgttttgtagatcctttgcacaggctgatccatctgcccagctctgcccacaacaaacccttcaccaaactcactgaccagtaaaaaatccctagtatgggctatcatggagctttgcaccacttcatagcatagccagagtgaaatcacacatagattctcatgatgacttttcagcgtcagtgttctcctctatacactaagctccataatttacatgagaaaaggaccttgtctatttgctattctacctccaatgtaacgtctggctcatagtgggaactcaaaaaatgttttcaatgaatatattacatcgttatacatatgttgtcatggaacacagacatacatttatctgtagaatgagggaactgatggagagaaggtattctatctcaataccagttttcaagtatgagtaagagttcagcatatggatgaatggggaatatggcacatgggcagaaggaacagcacatgcaaaagtgtggaatcatgaattaacatgaggtatttggaacattgccaaatgggctgatgtgactagggcaatgcgagttgtcttggaaagaaaagaggaaacagtgggcaagtaatgagaaatggggagttaagcagacattatgcagcattattcaaagaactatcaataaatgaaaagaatattttctgagaagtcacatgtgttggggtgtcgtctctccttgtaatacaagacctcataagagatgattggccgtgattgatgtttttataaacgttttatgcagatacaattcacgtactataaaattagtcctttattaagagaacagttcagagcttttagaatatgcacaggttgtacactagtcaccactatctaattctagaatatctttataattccaataggaagctccacctccatcaatagtcacttctcatttatctctctccctagctcctggcaaccaccaatgcattttttatctttatggattttactattctggatatcctacatgaatggaatcatacaatatgtggtcttttgtgtttcgcttctttcacttagtattttcatggttcattcacattgggtcatatatcagtactttgtttctttgtatgcttatataatattccattgtattggtgtatcacattttgtttatccattcatctcttgatagatatttgacttgttttaaaattttgtctattatgaccaatgctgcctcaaacattcatgcacaagctgttgtgtgggtatatgccttcatttctcataggtatatagctagagtagaattgctgatccataggatactttatatttagccttttgaagaacttacagactgtcctccaaggtggctgtgctgttttacattcccaccaactgtattagtctattaattctccacatccttgccaaacttgtttttgtctctctttttgattaaagtcatcatagtgggtgtgaagtgatatctcattgtggttttgatttgcatttttctggtaaataatggtgctaaacatcttcttatgtgcttattggcgattagtatatcttctttggagaattatttatgcaactcctttgttcatttttaaattggattatttgacattttattgcttttacatattttgacagtagtccgttattagatatatgattttcaaatactttgtcttattttgtggattttcttttcacttgcttgatagtgtgttttgaagcacaaacacttttaatttgaatgaagtccggtttatctattttttctgctgttgcttgtgcttcttgtggtatagctaaggattcatcacctaatcaaaggctacatagtttttcttgtgttttcttctaagttttagcccttacatttaggtctttgatctattaatgttttgagttaatttttgtatatggtatgaagtaggggtccaacttcactgtcttgcaaggggatagccacttgtctcagtaccattcattgaaaacactattcattcctcattgaattgacttggcaccttgttggaaatgaactgaccataaaatgtggatatatttttggattctcaattctattccattgatgtatatgcctatccttatgctgatttttaattgtgcatattttctaagaatgtgttgggaattaaaggaagcaatgtatatacagcacttaatgctaggcttcaagaaataaacatgaactattttgttgttgctgctggtggtgttattactctgttcccaggaggagctcactgataagacccaacttgttgctgaaagaccatcggctcccagggttttagaccagaacagacctggggatttacaatccaatgcctccattctaaaattaaccaaaacaaattaacaacaatgcacacacacaaacatatgagcacacaagtgcacatacagctctagccagatacattaaatgattagaaaaatgtcacagagctacagaaggaaaatattcagaatctgctcctccttacacttcatgcagtgctttttgcaaaatattatactatttgagtatacagaatatcacataacctagcctagataaatgccataattctcaatttgcttctggtttaagaaataaacatttctattaaaatgcaaaaaggtagccccagaaggataaaacattggatccttaaaagtcttttcggtattatttttgtaaaatagccttgagtgtttaaaactgtaatgaaaagtatttcacatttatattagctttcacatggtctcttaatattttgttattccctgataataataacaacaataaagtaaaaacaataataatagatttttaagccattttgaaataattatcactaatctaatctccatatctctgtgatgcaaatatttttatgcccatttcacagtagaggaagctgaaacttaatggcttgtgtacaaaaatcacacagaaaatagtaggaaaaaaattgtgttcaaaccttagcccctgtgactccaaatcccaagatttctttttctaactctgacatacagtcttaaataaaacagttaaaactagacaaccaaatattgtgactggtcagagacagggcagagttgtgatggagggaaaggctgcccttgcagttaccttgtggagccatctctaatggagagcaggccctggagggacaggatgctgagggatgtaatggaagctgggcagctctgggtgactgggagaggaccagacagaacaggtgccccttgcgggggtgtagcaatgactcctaatcttggctgcatgccaaattcaccttgaggactttctgacactattgcttcctgttctgattcagctctaataatctgcaattaaaaaaaaattcccagagagttcttgacaacgtgggagttcttgacaatgtggagagaatgaggaagcagccttcaataagcacctacttttggccaaggattgagctcagagttttacccataccttcacccaaaccataagcaggtgtcatgaacactcctcctaggggaggaaaccgcaagatccagaactcacctgcacacaggcatccagctgaagagaggccaggaccagagtctggagctgtgtgaccccaaggccagtgctgtcctggtgacctgaacccctctcactgggtctggccctgagggttaagactgtgtcccagcatcctgtcttatgggcacacgtcagttcctttatcttgtcctgtctacctcagagctgttgtcaagaacaaattagataataaagccccaaacacccatcacatacgaggtatcattacttattgcattgctaagggtgtgggcaaggctgaggtagggagcagcagcagccacctctgcatctggtcccaggcccacttttcttctgcctctcagctgagatgaggtctgggtcctggctgggcaggacatggtgctgatgtcctgtaccctgttccttctagaaacagacaccccctaaaagaaaacattttaaaagccaatttcttcatacacatgtgagattttccctgtgcatttgcttaggcccaatagctcagtttaagaggaggaaattgatggttagttattgaatatgcactttttactctggtagctagagagtttatgcactttttactctggtagctagagtgtttatgcacatacatactctacatatactctatgtagatatgaaatatatagtaatgttatactatattattaaatataatatacaatatattataccatattattatatataacatatcatataatgtatttaaatatatatatatatgtgtgtgtgtatatctccaaggtaagctttatttatttataagtcccaacttaaagttggaaactaagatttaggaaatgagcaattaggcacagattaagccatttctctgattctaaatggcatgaacaatatcaacaatgagtatatacaaaggctaataacagctaacatttaccaggtactcacttatttccaggcactgtgctcctctgttgaatacatttatatttagttcttgcaacaacctgaagagacaagtttttcatccccattgtacagatgaggagccatgggcttagactcagtaaataaaagttgtccaatgccaagcaggtctattggacttcagaactggaggcatgttccctggcctctcacttccgtttccaccacatcatatcaactttatgcagggtggggctgatatgtgcaaaatcacacatttcaatcccaactaactttacagaaagacatgtttcatctttgggaaagccttttccagctcaagtcttctctctcacaagtacacaatcgtttgagtaaaacagtatacagagtagtcatttatttatttaacaagtttttattaagcatctattaaatattatgtggcaagcacagttctaattactgggagtgtagtggtttataaagcagatagtttagtgggccagagagatgttaaacaaataatcatataaatggatataaaagcacaaaactatgtatgttttatacaagaaaatgtaaaggttgaggagagattgtaacaagaggacctgaagtagttattgagggtgggagactggggtcattagcaaagacttctctgaggacgtgacattaaaactgagcccagaaaaaaaaattacacatgtgaagaataggatggtgaggatttcagggagaggatagagcaaatgtcaatctctaggatgggaaacacttgacacattaaaagatgctgaatttagaaacccatgcactcatacattatgtttatagggataaagaagatgttactgcatgtcagtcattgtgtgtataataggaatgtgaggatacctatcacagatcttgtccatgggatagctcagttgcaaagataaatggtgtgataaaggcataaacaagattgtcttgggaagaagagaaagagcaattcaggcatcacaaataagctctgaatgtgagttgagaactggagagtgggtggatcagatggcataggtgtgggaatgggttttccaagcagagggaattgtatgtacaattaaaggtacaaataaaggtacaggtaaatatacaagtaaaggtacaaagctgagagggtgatggagctctggggagaggctttagagaagggcctagaagttatgttttggacagactgcaaaacaaatggttttgtaaatcctgctaagaagttttagaccttccgtctttagcaaggggcagatgttggaggttttaggcagaagcaagatatttaaaagataactgtggtatttctacctctgtctattggtcatctatttgtctatccgtctatctgtccgtttatctatctatcatctatctctttctagctacccacctacttacccaacctctgtcaatgtatcatctgtcttgctatatttctatctatattgatctttcttctgcctagctattacccatctgtcatctatccaaaatgaccacattttgaagttaccgtagttgtgcattgaaccctctgcacaatctatgcaaaggccctattgtaaaacaccaccatcagtgaaagataagcagatacctgcagcaccagcagggaaggctcaatagcgtctgcacagataacacactgtgctacttattatcctttagttaaactctgtgggtcttatcattttctttgagtaatttgggcatttcagataaggttattattcatttcttaatgtttatgtgtatatttacaagcagtagcaatatgtatagattcatttgctacagatacttgtctaaaaattaaacaaagatctgccaaaatacggagaagcacttaaaagctatccccaagtgttcctttcttcacaaagtcatcatggaaacaagggtggagttgtagtgatattgccaattcaattcagatttaaatttacgttaaaagtattgaataccttccttggcaagcagcatgcatggccctggggaaacaaggacggtgaagatgggcttctcctgttgtggtccgcagtgtgcaaggggcgctgacttgaatgggatggttttgttcctcatggcaggtactgggaggggagatgctctgggaaggcatttgaagcagagcacacaaatgcatgaacgcttctggatggaaatactgtgtttggggaattgatcaacaataaacaaagaggaatcataatgcagtgagatgagctctcatttactaaccctgtaattttgatccatttatctccccatgcctcagtttcttcaatattaatagtgagaatatttattctatttatctcaccatttgtaaggatcttctctccataaacaagcaatttgaaaacaacaaagttgcatattaatgttagtttctaaggatatcataattaagaagaaaagaacttccctttctgccaattcatcctctgcacttccttttctgctggcgatccacaccctaaaactgtacttatctttcctccttggagacaatgacagagaacatgacggagctacagaggaaagcagacaacactacctgggcttagagggaacatcttggttagtcttcgcgatcccacttcaggaagctctttcctaatgggtgacattgactgagcgcctgagcaatgaggatgacatgctaagcatccatggaattttacatatctcttaatccagcatccttcacactatcgcatgagatacgatgtctgtggaaagaacagttctgagttggtggctgtgctgagttctatcctgaggcaccatagctgtctccattcactgactgtgctttccccagctgtgtgtaacttactatcagggagcctctaggatctgaaaaaaaattaagacaaaaaacttcagatggccgaacacttccagctgaagcgacgttattctgagaatattttggaagttgcactcgagttgttgctttacagaagtgaaaaaagtattgacatttctaagcccagaactattttttaacaagctagaaaatataggaaaaaaaaaaaacgggtagaacatgtttctcaagagaatgcagtgtagctagaatgtacactatttttttcccagcatgtatttgggtaaaatatgtgcactgaaatttcaggccaaatcctaatgcagaaataatcccaaatatggcagatttataagctaggcaatttttatttatttgctaatgtagattcccttaagagctcaaatgttctactttttactcttggcttctccttgaaaagacttacctgtaaggtctcagcagcgtaaaactccaagctgcaaaatcgtctgaattcagcatttgccataattctcctttgacatcaactcaggttggtttggaattgacttgcactgtacctgtttggtaattaataattcacaattaaattggcagtacaaataaatcagcatgtctgcaggcttggagcctccactctctgtgttatcttccttttatttgaggatctgaaagaaaattagaaagaaaggtttgagtatctaaagtcttccattcaaagctttacctcccttagttttgggacttcttttcaatctgttttggatctttctttcaaagagaaattaagcatgtaccattgtcagcctgtgtgatttacactgaggagtagagatgtgtgtgattccacacttgccctccagctcctcatcctctaggtgcaaagacagtcagaagacaataaactgccatacacagagcatgttcaatacccttcctgagacaggtctaaacaaaatgcagcagaagagatggctgcttctgctttcaggatgtggggagaggtcagggcaaatggcagaggagagaggatgttggggtaccctttgaaagatgagtcatatctgttcaggtagggaatcaagaaaagacagtcaaggaatagaaaagttataggagtgctgatgcttttaaaatatttgggagaggacaaggggccagtgtgtgccatgtactgtgttagaggaaacagggcctgagatgaggtttgtcagtgggtttgggggttcgactccagagagctcaggtcatgcagaagggtttgtttgcttgttaaacctggtagagtgtgtgccatgtgctgtgttagaggaaacggggcctgagatgaggttcatcggtggttttgggcgttcgactccagagagctcaggtcatgcagaagggtttgtttgtcaaacatggtaggccattctggggtgaaggagtaaggaggacagcagtttgcttccatgattacttggaaagactgctctggttacatgtagggaatagattggagggaccccaaaatggaaagagaccaggtggaaggttcacggtgggaggctattgcaattatctccgtgaaaattggtgagaaacaaccaggacagtggtgatgataaataagaggtgagaaggaatctaggagttttccaatactgacctttaagttgaagagcatcaaggcctggaggtgagagagtaagaccaagtgtcattttaggctttgtagtgctgtgggtacatgggcatggtcctggcccatgagaggaaaactgttgtttgtgaaatatgttttttctgtcatcatcatgatcattgtcatcatcatcttaggagctaacatttattgagtgcttactttatatcagtcactctgctaagccattatttcacctaaacctcacaatacagtgagtttagctaccattatcatccacatttcctgagtgagaagaataaagctcaaagggacaaaggcaggtcaccttgctaacggtcatgtagcaggtgaggaattaaactgattaaaacactggtctatctgaatccagagccctgctcctaaccagtaggatatgatgccatttaaaaaatacaatttggagtacaatctcatggttacagtaacagtaaggacacccacacattgctggttggatccaggattttccaactctatcaagagagtcagaaaatttcactgagttttaaaggatgtgtcttaagggatgattggggattttcaggttaaaataagtgagaaataaaagagttccacaatggaacaacctgttcaaggtcaaagattttaaaagggtctgggatactcagaaaatagtaactaactcagcgttatcagcattttgagtgcaatgttggggaaggcttgaggctgaggacagggctccctaatggttatcagcttatgccactgattccactaaaaacagtagacatggggataaacaggagctcttggaaggctttgtgaatatttttgattttgcctttcaatcaacagtcacaccatctctcaattcctctgcttcccaccgctcttcccacatctgcctcctgctatcgccaaggtataatatagagctccttctaccataaatacaaggtaaatgtatatggccatatccttggcaaatcaagcaacttgaaatttattactgcaaacaatatttattataaaaacatgctatacaaaaatttgtaggctaacacctccttttaagtgcaaagaattattctcaggtatttcttctatcctgtttccttacagttcctcctcagatcatgaatatctcctcagacatcactgtgaatgagggaagcagtgtgaccctgctgtgtcttgctattggcagaccagagccaactgtgacatggagacacctgtcagtcaagggtaaggtgctgacctggaggacgttttcagaggtagtatgttaaagtcttggctcttatgcacaacagagcttcaggaatcagaaaacattttgtaatccagtcatagaaaatcaaacaggcaatatgcaccaattgctggctatttcatttcaaaagaaggattcatagaggaaatttgctaaatgatggtgtcagtcatttttatggccttagatggcttttgttttccaaactatgaagaacaaaggacataagaataacttccaatgaagatgtgaatttctgaaagtagaggtgggtcagttggtggtttgttcttcctggaagtagagtgcaagagtattagcgtggccatggagaactttggcattattgtgcgtccaggagtaaaaggatctccttgcttcagcacttttaggacatttatccagagccacacatgtctgacatgtccataaatagttcaccttgagtggaagaaggatgatggaaatggttaagtgcatttgggcatgactgtgctgagcattcaataattggtatgaaaacatcagttaaaaccatttccaacttaatagcaagggaaccagaaggacagtggggcttgccctcttggaaataaaacttgccccaagtcaaacttgaagaggtgggcacagagccacttgaaatatttacactgttactaaaagctgtgattaagtctaggaattatacaagaaacaagagcttcctcaggcattaaacattcaaacatgaaaccaagtaagcaggaaaaatgtatggaatatggctacataacattcaaaaataatattgatctacaagaaagtttaagagtaaatcttagtaatattgagaaagacaaagctttgccaggacaagaaaagccctaaccgtaacagaagaaaagtgataaattcatattaatactgaaatactcaaaactgtgtgatttaaataacagaaatttatctcctcacttctctggaggctagatgtctgagatcaaggaatcagcagggttggttcctttcaagagtctgagggagaatccattccacgtctttcccctagatgctgatggtttgctggtaatcactggcattgcttgacttgtaaatatattaccctgatctctgccttcatcttcacatggccctcttcctagatgcatctgtgtccaagttgttccttttaataaggatataagccataatatatcagtgtccacacgagtaacttcgttttaacttgattacctctgtaaagaccctattcctaaataaggtcacattctgaggaatcaggggttaggaattcaaggtatcatttttataggcttgtaacttaactcgtcatagccttcatcaaaattaaaaaccttcggtggagacacagactggataaaaacatttcttgtacatatatttgacaaaaaatttacatctagtgtatatgaagaattcttccaacacaattctaacactccacttcaaactgaaaaaaaaaatgggcaattccaaaagaagatacagtatatgaatggcaaataagtacacaaaaatatgactaacatcttcatcatataaataaaaatcaaaccaagatgagataccgttatataatccctaggaagactaaaattataaaggctgataatatcgagtgttggtgaggatgtggatcaactgaagctttatatattaactctgcaactgtgaaaacatataagccctataggaaacaatttcacattttgttataaagttaaacatacacttagcgtacgacccagcaattccactcctaggcatttattcaagataaatgaaagcatatgctcacaaatgtacattgtacacaaatgtttttagcagcttcattaataatagctgtaaacgacgaataacccaaataaccattgacaggcaaatagattaattgtggaatattctaacaacagattgctactcagcaattaacaggaacaaaccactggtgcacataacaaaatggataaatctcaaaaacggcatgctgaggaagttaagctaaaaattaaaaaatacatgctgtatgaatttgtttgcatgaaatcctataataggaaaaactaatctagaatggcagaagtcaagtcagtggttacctagggtagggattaggggagaagtgacggcaaagggccacaagaaattctgggggatgttggaaaagttctgtatcttgaaggttatgttggtgtcaaaattagtcaaaactaataaaactgtaaaaaaaagtgcattttattgtaggtaattatattgcaattaaatttgaagtataaatataccgaaatgtagacaataatgatctgaatttttttcttaatttggaacattatttatgtcattgcacttatcaaataagagactggatcttttaccaggagcatcattcaatcttttgctgctttttactttgtggactgagaacacgtatttttgctcctgccttgttatagggaaagataatgctaataaattagcctaatattcttggtataaagacctcagctattaaaacctagaatgtctctatatcataaagtaaaattaatgagagtattaaagtatatgtaagggatatcgcaaaactcaaatttaatataaacagagcaataatgttccccaagacatgggttccatgataattttgcctaaagttagagataattttggatttatattatatacaaaactatgtctaacttttatatatttggtaaaatcaaatgtctttataaatgcttgaaatcccagaatgtagttatttgatcctaaacacacagttctctaagcttggaaatcatttaaaaggcattttaactttgtgtaaatgtcctgaaacaattcattataatggtacactggtaagattttccttttaaaataagggagattcattcatattcccaatcttttacagagtgtaatagttgcaatttagcctcactggaaaatcctaaatttaaatgatccctctcttctttaaatctcacaggctgtgctgtactttgaagttgcctttgttttctcataggcttggccttaactttgttatccttaattttcactattgtcttcccccttccctctctcaatgacatttaagcatttgaactccaaaaaattgtttcctttgaaaagcgcacgggccatgctaatcttctctgtatcgttccaattttatacctaatgtaggtgacgggttgatgggtgcagcaaaccaccatggcacgtgtatacctatgtaacaaaactgcatgttctgcacatgtatcccagaacttaaaatataataataaaaaagaaaagctctggaacatgaagtatttgtaagtttaaaatttgcatctgcagggtgactgccaatatttattttcagaaggatgctccttctcacttgcaattagggagttgttctaaaagattagaagtacattcaataaaacttgaacatcaaacagcatttttttggaaaaatttgttgatggattcaacatggaagaataagaaataaaggttgcaatgacattttctttcaaattccagtaggattatggtggaggagttagctaatgcaatatttgaaatatatgatttaaatttggggatctataaacagggacaagtaaatcagccttcatttaagaaaaatattttaatgagcagttattaaaaattaaaaatagtaacaatcacacttacagtttaagatggcaatatgagtacatgctgttcaccccttacaattacagaaaagaggtaaaaataaatgaataaataaatccattatcacattggagaaaaataatagtaagctttgatggatcagaaactatgaggattctctgaaatataaaaagtagacagatataatgaaggaaaaaatacagctcaaaatacagaaatgcgatctctacctgagatgataatggttgaagagtgaaggtttcaggtagtgctgcactggtaagtgagtaaagttgattggagtgggaggaggcaagggaatgagaggagtctgggtagcctctgcccatgttggtggtgtaaatactcccatcattgatgtttctggggaacccctttgaagtaactttgcttttcaggtatatttgtttcacaaaaacaaacaaaccaaagacatatccttcttaccaaaggagggtaaaagttttgaagcatccccaagtttccaaaggtggatcccaagacatcccagcttttctactctgtagactgcgtaagctgctggagccctgtcgacctctcatctccttggcagtacttaaagtgtaccaggattcccagaacctgggcattttctgaggacacatgcctcacttttgaggaaagctggatgttaccaggatcatgattaagtgttgtgaacataacgaaaagcactatgcaaacgtccctttggggttttgctgtttctatgcaaactgctgaacttttgactgtgtattcattcttgatctttagatacaaaaatctatacttaattttttcaatagcagccaatggcttattaaaaatatttatatagatctgctagagggtatggtacttgtgtagcagccttcacacatatggaaatctgtacttagtgacccatggcccaggaagtaggatgatgatggaatcacacaggctgctgcctcaaataattttccaaaggaaaaagtcaggtcccaaaacaagcaagcaaggtgtattggaatacattgtgaatcagctgcacttcaagaattacttcctttcccgttcctgaaagacaagagaagggaagctgggccagcataaactggcaggctcttctaggcacatgagtaatgtgaaaaagttgcagggatgggagtggcagaagatcctggagtctgttgtgttctaaggagggtagtcgtcccctcttgcaatgccatagtcgtccactgcgatgcctcacacacctggctccattgccatgacatatttggaaaggctagatgtttgggaaaaataacaaaggcttccttcctgtctcccctccactgagattttaagatgacaactcttcacctatgagttgctcatggagtctactcagatacagtaacatctcagggagcaagtgcatgagctatttcatacaagtgaattttccaggtaaccaaagctgactcttttatgcatttactcaagttatttctaatgaaagcatttaaaacatgaattaggttgtactttgtgtatttgtgtctagtgaatgccatttagcctcatctttatattgtaacatcaagattatacatatcgattgtatcttggcatttggggactgggataactaggaatatgaccctttaatactgtcaatactgtttaaattcttgtgtctttttaaaaatagctactgtattttttctttcttccattcaatcagacttgtcagttcttcctaaagtcagtgcacctgtcttttagcagccgcatttcttctgatctgcttctaatttgtcttgagcaagaatccataaaactaagttgattagtcctaaataagaactagtggtgggaaagggccttctctgagtatagggcattagctttcaggaatgtgatcaatggcactgatgacacctgtctgggggaaataatgtttggctttgttctagatatatgaggatgataaatgagtgaattccatggaagtaaagagctaatactagcaaaatcaccacctatggttatcacctggttaggcagttttgtcttctagtcactctggtagatgttcaggttagaaatgtactgatcagctgagcgcggtggctcatgcctttaatcagagcactttgggaggctgagatgggcggatcacctgaggtcaggagttcaagatcagcttggccagcagggtgaaaccccatctctacaaccacgcctgtagttgcaactgctcaggaggctgacgcaggagaatcgcttgaacccaggaggcggaggttgcagtgagccgagatcaggccatttcactgcaacccgggtgataaaagcgaaactctgtctcaaacaaaaaagtactgatccatgactgtttctgctacagcgttcatttttcatgctagaaattcctaaagagaaagttttagaaggaatcaccaagttcttagcactccaaataaaagatgcactgacccgcacttgtgtataggtatcgatccctgttggatggtggtgttagcccattggcagaacatggacttcagagtcttatcaacctaagcatgagatctggactgagttgttaacgccctgagtgactttcgaaatgtcgatttatctcactgatcctcaaaaccctttactgcaaaatgggaacaactttatcagtttattttaggaatcaaaagagagaatgaatggaaagcaggtaatagtgttgaatcctaactcaacagttatttctgaactgtagttgtgccatatttgcatttgaatgcattctttgaatccatgtagcatacagatagcctgggtacttgttatgatggtattatgatgagtgcatactgcatgcccagccctgttttgtacattttttgtgttttaactcattgaatgtgccagcagccttgggagaaaagtgataatttttactattttattacctcttgtctttgtctcttattccttgacagtccagaggtctttgattcatttctttggcctgagtgtagagtgggaatgatatagcagttttatttgtgataggcaaaaaggcaaatgtccttcattgggtatatggttaaactgtggtacaatcacaccatgaaatactacacagcaatacaaaggaatgaactattgttacatttgacaacttggatggacctgaaaggcattgtgatgaataagaagagttggtctcaaaaggttgcatattgtatgattacacttttataacattcttgagttgtcaaaattgtaaatatgcacaacaggccagcagttgccagtggtgagagtggcaaaaggaaagggaagcagaaggcagttgccttgggttgatggagctgtactgtatcttgattgttatggtacctatatgactctatatgtgtgactgaatgttgccgaactatacacaaagacataaaaataagtacatgcaaaaactagtgaaatccaagtaaactccacagtgcaattattcataactttatttatttttaatttttaattttaattttaatttactttaagttctggaatgtgcaggatgtgcaggtttgttacataggtatacttgtgccatggtggtttgctgcacctatcaacccatcatctaggttttgagcccagcatgcattaggtatttgtcttaatgctcacgctccccttccccctcacaccccgacaagccccagtgtgtattgttctcctccctgtgtccagagaacatgcagtatttggttttctgttcctgtgttagtttgctgagaatgatggcttccagcttcatccatgtccctgcaaaggacatgatctcattcttttttatggctgcatagtattctgtggtgtactaaaacaccaaaagcaattgaaagaaaagccaaaattgacaaatgggatctaattaaactaaagagcttctgcacagcaaaataaaccagcatcagagtgaacaggcaatctacagaatgggagaaactttttgcaatctactcatctgacaaagatcaaatatcaggaatctataaggaacttaaagaaatttacaagataaaaaaacagtcctatcaaaaagtgggcaaaggatatgaacagatacttctgaaaagaagacatttatgtggccaaaaaacatgaaaaaaagctcatcatcacagatcactagagaaatgcaaatcaaaatcacaatgagataccatctcatgccagtcagaatggcaattattaaaaattcaggaaacaatgaatggttgtggagaaataggaatgctttcacactgttggtgggagtattaattagttcaaccattgtggaagaccatggcgattcctcaaggatctggaaccaggaataccatttgacccagcaatctcattactgggtaatggtatttggtatatacctaaaggattataaatcattctactataaagacacatccacacatatgtttattgcagcactatttacaatagcaaagacttggaaccaacccaaatgcccatcaatgatagactggataaagaaaatgtgtcacatacaactttataaatacaactttatatataatactatatgcatacacacacacacacacacacacacacacatatatatttagttacataagatgacaccattgggggagatgggtgatagtactgggtacctatctctaccatttttgcaacttcctgtggatcgacaattatttccaatgaaacaattaaaaaaatagaaatacaaggaaaatgagtctctagtattccattaacaacctattcctatatatgcttatataagaatttgttgtttctaaaatattttcacatgaatcatctcaagtgggtttatagcagctccctaaaataggtcagagaaagaataatttgtctatttcacagggagggaaacagatggaaaggttaagtaatgacaaatgaatcacagctaactaaaatggtagctttatgaaaagaacctagttcctgattttcaagtctggagctctttatattatacaaagatggcttccatagcttgaggttggaataggtataatgtaaaatgatatattgaatcaaattctgcttgttatctggggcacccaagggtgctcactagctttgaacatcacccatactcttgccttgcctttcctaagtccacacctaccttcctatgtctagtctctttctagcttccactcagtattgttctaacaaaagcacagcctccaaatcaaagccacattcatgccattgtccgctgtaggtccctgttgttcctctgtgtcaattaaaataaacctgctgagacttcccaacgtcatttctcttctaagccatcccaggtaacagttccagccactaataggaattgcctattagttgacctgctgcatcatccagtcttgctactacttctttgtctctctccaaggcagctaggagccttgtttctaatctgaagtcatgtttagagcctaattaatccctggagtgtgagaaagaggtgtctgagatgagaaatcaaggttatacatatcttgctcagtggaacagttatgggcaaacaagctgttcctctcacatttttgcaaagcaaatttatgttcactaactttggttcttgttgtaaatgagaagtgtgtgaaggtctagcaatgtgcttttcgccatatgggtacccatatgttttccccctttgcttgcgtacattttcgctttggcatgcacatatgcctgtatttttgcaacttaacaatattaaaactaatcccatttatgctccttttgggtgagttgattgagtcataaattcctgagaatctccttcttgggaggctgaagttcttttgtgcaagcgggaggatggcagagcaatctatcctagcagagggatgccttcagcaagcgtcactgtgcagctgatggccctgacccaaactccggagtgctaacctaacactggaagtctcagaaatgtagattcataatgccttcacattgacccccaccttccctccccaaggtggaaaaccctcactaagaaataagtagtaattacctagggttctctttctaaagtcccaggtgaattaacacatcttacaacaaacaattatgatgtctttaagctgtggttcttgataggtgaccacactttctacttaatactcctcacactgaattgagaaactatgcatgtcagaaatgggacagctggaaattaggcttgcacagaaatgatgcttagattcttcactgggcattttagagaataaatatgagaatggatatcacttgtatcatatctagtgaaaaacccaactaacttaaatgtaaaattggaactggaaatcctgcctaccgtctgttgtaaagctgtctatctttgtctcttatgccctcattcattcactcatttaatgcattaagactatttgctttccctttagcaacaatgatgtgtaagatagacgttgttcctgccggtctggagcctatggtctagtgggagagatagctatttatcaggtgatcaaggccatggcatctcacagtgtggtagctgctgtgaggatgggaaaaagtgtggtatagcctagggtaacttttccctgagatagtgacatttgaacagacacctgaagattaacagaagtcagggaggaggggaactggaatgagtgcatgtattgaggctgggctgagtagaagccttcaaggcagggaacagcacatccaaatgtcccgaggtgtgctggagctggctcttcaagttaaaaagagctgtgtcttgaatgcatagaaagcaggtgagacaatggcctgagatgggatactcatagaccagattgcctacagccctttaaagagttaggtcctttgcaaggacatggatgaagctggaagccatcatcctcagcaaactaacacaggaacagaaaaccaaacactgcatgttctcactcataagtgggtgttgaacaatgagaatacatgggcacagtgaagggaacaacacacactggggcctgtcgggggtgggggcaatgggagggagagcatcaagataaatagctaatgcatgcgggtcttaaaacctaggtgatgggttgataggcgcagcaaacaactatggcacatgtatacctatctaacaaggctgcatgttctgcaaatgtatcctggaacttaaagtaaagaaaataattttttaaaaaagttttgtctttattctgatagcacttggaaatagcaaaagagtttcaagtaagagagcttggaagtaagatgttcattgtctggatttaactaagaacatctcatttctgatctactcattctctatgtaaatctgcagttgactaaacctctgtctatttccccacctagaaaccagaaactaattagtaataatatgctttacatatggaggaatggaggatggattctgatagtatctattctgaatactttctacattataatatgagaatgaatattaacatgtatcatagcaaatgaaaagcccaactaactcaaaagtaaaattacaattggaaaggcacccattgctgcctgctgtatgttgtaaagccttctctatgcaattgctatatcaaattatgctattgaaatcagtcagacactgataaaattgagaccgactttacaagttctgtagatctaattggcctcagcagtgggtccacagtgactcttgctgctgaacaaaaaatgtgggcttcaatagaaaataataagcagcctggttccatactaacatactgcagccacctctggagataatgcactttaatttagacactgagctccttcatctggccagatgttgaaggaatcttagaaaggtttgtttcctccttccctcctggatgagcacccttgatagtacatttgaaagacctctgggtccagctctgtgcacctaccacccttggtgttcccttttcaaagccatttatacttctttctaaaaatctctacatccctagggtaaaattcctataagtcaccttttcttgcttaagctgttttaaattaggtttccatcacttagagccaaagtagctctgattaaattcacatgccatgtagagggcagtatctaactgagccaagtagaacataatccctgctctaaactgagagccgtgtagaatggggagacacgtacatggtaccacaaggtgactggggcctaaccagctgtgaaaagacctctttcatatgtagaagagatagagaggtggcggcctggagtcattgattaacttttcaagcccactgtctccaccatgggttgaagaacttgtggctggatttagaactctgggtgggcagcagaagaggttcgacatctaaatcagctagagtcagtctgagaaagacaccttggctgtgggtctgagtcatagagtaattaacaccagggggtcatcaccgactgagtgcaccaagcgcacaatgtttatttaatgcacgcatgcctaccatgagaaaggtgttgaggataccaccttgagtgactgaaactcagcctctctgtcatgatcaacctctcattactctggaaaaactttatgaagagcaattagtttgtttccatcaattgattcactaacctttccttgggatgatatgctccaccctggccagaaagtatcccttgcatctctctgtccttaggttatttgagagcaggtatggtacctggggcttacatattcagaagaacacaaatgacttacattttgcaggcgatcaaaaagtgactattgaatgggtacacacacatgtatccatcgtatatcgatcctgtagcgtgccagagaaaaaaaaggggaagacagtggagatttgcaaagacaagttcccagatgcaggaagcactctgtctgtacagtgaaggggaaatctgatgtacagagtgaaggatgtttggagaaggcacttcaagtcctagctgtattaggagcctgcaggaagttgcagacttatctcccaagcatttttcttccatttcccccactataactattagccctggatgacgagtgagcttactgctgacgttttaattatattaagttttaaccaaatagtgaggctatcctagtttaggcttctagacacggtgatctgtgatctggaagatatttttcaattcgtgtccaatcacttttttttactggagacctatgacttgtgctggaaaactcattgcctttaccaagaagatgcataacaagagttgggatgacttacctcaacagatacaatttgatttttacaaattggtgagtgatcttaccatcttacgccatccagttctctgtgtgacaccagaattttgaccttccctgtctctgcaggctcttttcttcctgctttcttccaagagcacctgaaatcataaacttcaactatgctgggtcttagctcccacatgtccgaggttgaagaatgactctagaaatgatggtagtgtgaagaagatcattcctccccagtttaaaggtagtaatcatggttaataagctgtttctctgtatgagattcagaagaaggaggaaaaggggaagaaaaccaactaacattgcttagaggattttaactagagtgggctctccagtctcacaaatgttccagccttggatagggaacctccactggagatgaatagggtcaagaggaggtgatctcatgaagtaaaagcagttgattttcacttcgaacctgggcttcacagctgaaggctgtgattgactcacacaataacaaggactggggttgagtgaggaggtgagggaatttgatctcccacagaacacctaaagtatagcccaactctccctaccctatttccctccttgtagcctgcaaagtgggaagcctccttaatcaaagaaggagatcaatgaagtcctttctgcctgtcttttgtttttcctttcctgtccccttccttgtgttatttttcttattctatcaaattttcccactccagaatcccttaatggtgagagtaatcctcctggggtgctgaaaatagtttggttttaatgataccttagatgattttgcttcctaagagaaagatttagtaaagtcattgatataaacagagccactagtcccctgcttttccaattctcttccttttcccaacaagctctgctcagctcacctctgctcttcacaccattgcagtctaaatgctttcatcctgggcctctccaggacctcctcctgctccacttagcccatgcttatttgtccctgcacaactggagcctggtgcagtaattacagctgtggtgaaagggtttgtctcccttgggcactcaggacgttgccagtgctgctggtgaagatctgagccacttttgtagggcatcatagggccgtggtgctctgggatgtcagacagcaagatgtttggaaccctacccactcctctttctctcccctactctgcactcttcttctttttactcctgacccagccccaaacttcctaccacactttgtatctttttggcaggattttctgtcccagaaggcatgaaagcagttggaacaaaggcagtttggcaaaaaaatattgagtcatattttaagactctcctgatattactgcacctctgattctgtctaaggagtaaagaagcttcagaggctgcgtgtagctggaattatactcccgagagcccaggccctccagaacccagcaggaatccacaaagaaaagcagactctgctgaagcatagggcttgactgtacatccttatcccctagtgttgctatctcaaatcacctcatcctgatactccttctctccttacctgccttcattcttaagagctactgatccttcaagctctgtcgcactggcctttgtccattgctgtttctggttgtgggcgactttcaagcctcccatgcttgctggactgtctcaacttctgattttttgcatgctttgactataagtcaatatcataaaaccatgccatggcatgtcctcattgtcatcatcattatcaccaaaatcatcctttaaatttattgacatgccactttgacttaatcttggttttcaaaaaggtcttctgtcaaaaggcagacaaaaataaataagcaagtacttaaaaatagcatatagacagagactaccatacacactttacacagaaggaaatggagactttggctaaatgtattgcatctggaaacaacattccttcaattatttatttattcatgcacttgttcagtcattcaagaatgaattagtgggtgccttctacgtgttatgtactgtgtttgaaacagaagaataaataaaattatagttttctccaggaagctcaaagtttagtgaaaggctcagacataatagcatttaattatagtacaataaaagtgggtgcattagtgatatattcatcatgttgtaggttcacaggagaggatcatttaactccagttgttaaatgtgaaagaatcagggatggcatcctggaagaggtgactgctaatctggctgtaaacatagattcagagttattcaaaagaaggaaaatgaaatgggtgaggtagaggcaaagagaaatattctaggcaatggagataagagaagagacatgaaaatgggaaattgcatggtatacttagaaggataaaattcattttttcttattgaagcataaagtatgaacttgttgtactccaaataaagttgaactcatttgttgatggtcccattatgacactgctttccatggaaacaagtttgatcacacccgctaagaaaacaaaaacaaaaattaatgtaagcaaaatctgtattcaaatcttcaaaggggtccccaaaggacaaatgttttccataacaggtagtaaaatagttgaatgttgcttttttgccagtctttctatttcactcacagtttggcaatcttttctctttcccttccacattccatgagaattctatgctacccagatctctactttcttcccttatctgctttcctctttccataataattttctcagatttctaacataaaccaaataggcttcttctcttaacttcttcattaagcagcactaaccattgttctgcttaacattagggctacaaatcaagaaaacatctataccttgatatgtaatgaggtttgagaagtacatgaagagtgaatcatgaatggctaaacagacagtgaacataagggaagaacaagggctttttatttaaaaaaatcttgcggtcataatttaaattaccgcagcttttggtgagttttgacaaatttatatatctatataatcactatcctaatcaagatacagcatattaccattacctcaaaagcttccctgtttcttattcttcccaaaacctatccccactttcaacttgaggcaaacactgatatgttttctgctgttatatattagacttttttagagtttaatatatatatattacatgtatatatttagcaaaatatgtatatgcattctatatgtatatataatctacatgacacaaatatatatttaaaacatgtgtatatgaactatatattgcaccctacacacatatctacactctgaaaaaaatgtaaaatcttgtataattttagaacatatactcttgtttctggatttcttcactcaccttttgagttttattcatgttgtgtgtggtttttttattgctaagtggcattctattatatgattgtaccactgtttgtttactcatttgccagttgggtggacatttggttgtttctactttttggctattatgagtaaagctgctataaacacgtatgtacaggcctttttctggacatatatttacaattttcttgagtaaatacttaggagcagaattggtaagtcgtatagtaagtttatacttaacgttacaaaaagccaccaaactattttccaaaatggttgtaccaatttgtattcctataagcactatagctgttccacaggcttgtcattgtatagtatcctgtctttgaaatattatctattctaataactgtgtaggctaaaacatatttggttttgagttgtttttctttgaggattaatgagtttgggcatatttttcacatggtcattggccattggtatatctaattttgtgaagtagtggttgaaatcttctgactgtttctaattgggctgtttatcttttattatggagtcataatttatatattctagatacatgtcttatgtcagctatatgtattcggaataatttctcttagcctatgctttgccttctcattttcttaatggtgcttctaaaggaatcttgtaaaggaattcagttttacatttggatgaagtccaatttatcaatatttcacacttaatggaggttaaaaacgttatattctatgttttttttctagatgttttagaactgtaacttttttgtttagctgtaagatccatgtgagttagtttatgtgcatggtatgagctaacatttgagattcattttttttccatacagctctacagttaatccaaaagcatctgtggaaaacataatcctttttctaatgaattaccttagtttctttgttgaaaatcaattgactgatttctttctgggaatctctcttattttctattcatctatatgtctattcttatgcctgaaccatactgttttgattacaatcactgttaatgttttgaaatcagacaatgtagattgccaaacttgtttttttcaaaatagtggccaatctatgtcctttgtattttcatataattttataatcggtttgacaatatttaccaaaaagatgttaagattttgattgggaatgcatttaaattatatgttaattttggaacagttgacatttaatagtattgagtttttccaagccttaaaatatattcttccctttattaagtcttggctaatttttctcaacagtgttttatggctttcagtgtgtggttccaaattatgtcatatttttgaatgattataaaggaaattttaaaaatctcaattgttcattgaaaatacacagagatacaattgacttttttatattgaccttgcctactgtgacagctaaatgtattccttgattctagtactttttttagatacttaagattttttacataaatgatatgtcctctatgaggagatagttttactctttcataccagtcagtatgcctcttattaatttttcttgtcttattatactggctcagttctccagtaacatgatattaaaaatacattgtaatactgacatccttgtctaatttctgattagaggaaaaacactttatttttcccattaagaataatattatctgtaggttttttacagatgatctttatcagattgagaagttattttctattcctagtagctgatttgtgtgtatgtgtgtttattagtccgttttcatgctgctgataaagacataggaacaaaaagaggtttaattggacttaacagttccacatggctggggaagcctcagaatcatggcaagaggcaaaaggtatttcttacatggtggcagcaagagaaaatgaggaagaagcaaaagtggaaagccctgataaacccatcagatcttgtgagacttaatatcactatcaaaataatagcacaggaaagactgggccccatgattcaattacctcaccctgggtctttcccagaacatacgggaattctgggagatacaattcaagatgagatttgggtggggacaaagccaaataatattactctgcccctggcccctccaaatctcatgtcctcacatttcaaaaccaatcatgccttcccaacagtcccccaaagtcttaactcatttcaacattaacccaaaagtccacagtccaaagtctcatctgagacaagacaagtcccttccacctatgagcctgtaaaatcaaaagcaagctagttacttcctagatacgatgggggtacagatactgggtaaatatagtcattccaaaagggagaaattggccaaaacaaagggattacagggaccatgcaagtccaaaatccaacattgtggtcaaattttaaagctccaaaatgatctcctttgactccaggtctcatttccaggtcatgctgatgcaagaggtgggttcccatggtcttgggcagctctgcctctgtgggtttacagggtacagcttccctcccaactgctttcacgagcaggcattgagtatctgtggtttttccatgcacacagtgcaagctgttggtagatctaccattctgcagtctgaaggacagtagccctcttctcacagctcaactaggcagtgccccagtagggactctaggtgggagctcccaccccacatatcccttctgcactgccctagcagaggttctccatgagggccccacccctgcagcaaacttttgcctgggcatccaagcatttccatacatcttctgaaatctaggtgaaagtcctcaaaccttaattcttgacttctgtgcacctgcaggctcaacatcacatggaagctgccaagccttgggatttccaccctctgaagccacagcctgcgctgtacatgtgcccctttcagccacagtggctcagctgcgacacagggcaccaagtccctaggctgcacacaatacgaggaccctgggcctggcccacaaaatcactttttcctcctgggcctctgagcctgtgatgggaggggctgctatcaaggtctctgacatcctggagacatttcccccatggtcttgggaattaacattaggctccttgctacttgctcaaatttctgcagctggcgtgaatttctccctagaaatttttttttttctatcacgtagtcaggctgcaaattttctgaacatttatgctctgtttcccttttaaaactgaatgcctttaacagtactctttaacagtcacctcttgaatgctttgctgcttataaatttcttctgccagatacccaaaatcatctctctcaacttcaaagttccacaaatctgtaggacaaggacaaaatgccaccagtgtctttgctgaaacataccaagagtcacctttgctccacttcccaacaagttcctcatctccatctgagactacctcagcctggaccttattattcatatcattattggcactttggtcaaaaccattgacaagtatttagggaggtccaaacttttccacatgttcctgtcttcttctgagacctccaaactgttccaacatctgcctgttacccagttacaaagtcacttccacattttcatgtatcttttcagcagcatcccacttctggtaccaatttactgtattagtccattttcacgctgctgataaagacatacccaagactgggaagaaaaagaggtttaattggacttaagttccacatgtctggggaggccttagaatcatggtgggaggcaaaggcacttcttacatggtggtgacaagagaaaatgaggaaaaagcaaaagcggaaacccctaataattgcccattagatctcataagacctattcactatcacgagaatagcatgggaaagacccccatgcttcaattacctccccctgggtccctcccacaacacatgggaattctgggagatacaatgcaagatgagatttaggttgggacatggccaaaccataacagagtgtgtgtgtgtgactagatcttccattttgtccaatgttttttttggcatccattgaaatgattatatgattaattatgtgaaatgattttttaatggtagaccaaccttgcaaccaagaataaatctggtgtggtcatgacatactcatactatccttttttgcattagttgattaactttgtcaatattttgttactgattttccatctgttttgttcatgagggcaattggtctgtaatgttactgactggttttggtatcagtaattctggcctcataaaatgagttgggacatgttttccctttatttattttctgaaagagtttaaaaataactgatatcaacgtattccaaagcagtatttaataatattaatggttaacggttactttgccatttttattattgtaatagcaatatttctagtgttttctattaggtatgatgatggtttcagagagctcctttaccacttaaagaagaataccccttttcccatttcaataaaatgtttagtcaggaaaagataggtgttatcaaattttcttcttagataagttacaaaaatagtcatattattttttccctttcagccatatgtatgattttaaaatgatgtttattttttaatgtgaaaacattcttttttactccatatttactgtttttgctttagtagttataactaggaatatctctagtttatcatatttttaagaaacatgtctgtaagttttgtttacaacaccatactcaaattaattgatagatcctctatttgaactatgaattgtttaaaatataattaaaaattatattccttaaatgttagagaaaaattgtctctatagttattcaggttcaaacctagtttgtgagtattttttggcaattttaaaaaaaatttttgttgtttttaattcagaaattttacctttgaattaatttcggaaatgtataggttcaattttgataactgttcgatagttgtcaagtttatagatatttatgttaatgtatgagcacacaatagtatacattatataaacattgtacaaagtatatgtaattgaatatacctatagttatatataattcatatggtataaaatacttcattaatactacagtacaagataaatattaaacataaacatccagactgagagagaattctgttattcagattgtgcatagccatattgcattgtttgcttctctaaactttatgaaagcaaaaatgagtaataccggattttaataaagtgttttcagcttatctatgcattttaatactttttgctttatttttgtattttacacataaaattcaaaagtaattagagctttaatatgaattgcttcttttatcagtataattttttttttttttacaatttaatgttttaggcttacagttaaccttatctaactttaagattgtatttcctactttgattttgttaatactaaatgtacatttgctcagccttttaaaaaagatttgtattagtctgatttagatatagcttttgtaaacagagcagaaatatattctgttatcttttttttaatccaactgaagcctttttttcattataatggggagtttaacccacttgcaggtattaaaactgatgtgtttgtttctcgtcagctttttgttttcctctttttgttctgtctagtagctttcatgttttgtatcttgtgctatttgaaacaaattttctttgattttatcctctatagttttttgaaataaatatttgattttttatagtggtggttagatttatattttccaggagcatttgcagcctgtgtgagtcttattattcaagctgagtaaatgtttcctcacttcctctatgggaggtaagaattgcggcagcctcctttcatcctccttcctatcttggcactgtgtttctcagactatcaaaatcaccttttgaagtcacaatccgcgtttacatgttgagacattggcattttcatttagcttaattatcagatttataacaattcttccacctcattctttcgtattatgattcctttgtaggtgacactagttagcttttccctttgcttcatcttaagttcattggaatacatttcaagacgttttactaaaaagatgtgtgattgttgtattttctgattcttaggatatgtcttccttcaggtgataaacatttattgaaaacctgttttgcaataatagctggactaggtgctagagatacaatcataacacagactatccctcaagaagtgtttacctatgaagatttttttgttgctgtcaaatgcaattggagtatttcctgagcataaaatccaaaggtcacaatctttacccttaaaactcctgtggttaccccttcattatatttggcatttagtgatgaagtagagcaagctgaggtcttcttttctgatagttgtaattgtatgagtaatccattttctgtgtgaagataagaagatatgcctttatctgtgaggttgaaaattctttccgggagatgtgatgtgtctcttctgaattctcctaatatgcagtaagtctgttattaggcacacacatagattttttttttttttcgcagaaagtgggcatgtgttaaatatttaatggttggttctgttgtagctcgttctaaggaaacttagttccacgtgtgttggctctttcttctgtttccttcagatcttttgtctttctcttgctttcttaatctccttctgtcttttcttctgtatcccgggagagctgctcaggtttgaaattcactctgttgatttgattttttgaagcctcacatctgatatgttttacttctgatggagatttaaattttgttgctgttttaaggtcacttgcttgctctccatatctaactaattggacgttttcgttcatctcaacaacttttcttcttcggctctggtctatgtcattcttttccatcttttgccccttaagcagccttttcctgaaggctgtacttttctgcttctgtggaggttgtcaggtggctgtctacaattttaattagggttctggaagccgatttttttattgtgatatggtgcacatagcataaaacttaccactttaacctttttaagtgtacggctcgatcacatgaattgagtacattcacactgctgtacaatagaagtcatttattaaagcacggtcttcctggaatttttgtgactagtctttattttcctttttccacagtattttctcaatactcattctcgaaattggtgtgatctgtgtggtaagtggatggtgccttgcccctattctctgccttttgagtaaattttgagtcctgttttaattctactcttcaaatatttattaggctgcagagcttctggtttatttcacagtctctagcttccacctgttatacttctctttatgaaatggtactttttttcttgtcctctgagatctctgatgcatggtaatggttgaagaatttgaataatttagggcttggggggcactcattgactcctctggtttgaagctgcattggtattgcaagcccattgtgattgcttagaaagtctatgagggtagactccagggggacctcagtgaccccgcctcctgatattcacacccttgagcactcttcaccgtgttgcatcagtgctggtctgcatgaccatagcatacagccacacaatagctcgtggctccccagccaagtcataaaggccacgcttaccctgtgtcttaccctctctctcccgacaagtcattctgagagcagccagctgccatgccatgccctgacgacaccgagagttcttgtggtgagaaactcctgccaacaacctacatttaacctgccagcctggagcctggagcctgcaagccgcctgggaagtgcatcttccacttccaagtggatcctccagcctgggtcaacattcaaatgactgcagcaccaagtgatatcatgactgcaccctcatgagaaagcctggaccaaaagagacacagctctgaattcctgacccacagatatagtgtgagataataaatatgcattgcttggagccactaatttttgaggtgactttttagtcagcagtaaatagcgaatgcgtccatccaagtcagcgcttgtattgttaatggctgctcggcctccctttttgaagctttattatctgcataagggtaaagatagctatggaggcgtgtacttacttcttgtcttctttgaaatctttgtttcataaagataaggcatgccatgatttgagcattgtctctattaattaaatcaagtctatcttccttattagtattgtttgattgattttaggaactagattattcttcaatcttacttttcccaaaaatatgagtatcatttatttccaagtttttgcaagttatcttagtgagaagctgagagatgcatttgggtcttctatttcaatacaattttgaagcagatatctctccttgcttttaacaaaggtgcataaaagataccattatatctttaatatgctaggttactctaagagatagctaccacatctgtattttcttcaattttgcaaacgagataaaatatacagtccttggatcattgaggtagaaaaccatatctattttaaataaagatgatttttcttctttttctttatgtattccttcattttttctgacctcattgcattggctaaatttctgaaaaatattcaatattaataattataactagcatcctttgtcttcattctgttatcatcaaattgcctctagtggtttttgtactagttataatgctagtttctattttcaagatctcacttattgagatattataaataaatgtttaagttttattaaactcattgttttttaaatttttagagttcctcagttataatattgatactttttttcattcttggcattagtttcagacacaccatatttttaatgcattgttagattttatttgctaatagaattgtattcttgtaggtaaagcaccaaatgcaatagtggggacaggaaaatgtatgctgcctgacaatgcataagtgatcaataccttctatcagtagaagttgtggtaattactacgtgcactgactgctgtgaatttcagttttccaagtactgtgttggttctaggtactaataatggcaccaaggagaacctttgagatagggtagcaattttcctgacacctcaggaaaaaagtgtagcctcaaagttccaataaaacatcaccagccaacggagatgcaaaaatattgttaaactcaggttcttcaacattgcctttgtaatcaaccagtttccttagtgcctatatcccaagcgtagtgctagcttctgcactggcagtgtagaatagcgggggaagaccccaggtgactctgctgccaggggaccttgaataagtcacctaccatttttgagcctctagttctcatctgtaaaatggagcccatcagtcacccctgaactcctgtgaatattgctgtgaggatcagctataagggatgcgaaactgcttttgaaccagaatccactagaggcacttaaaagtatgtgtgttatcatcgtcatcgtgagagaggattgttaagccaaggcgccccactctctccagtgagcaggattcctgtgcttccatatgttattacaggcactgtgaaccagggtttacattttactgctacttaattaccccttctcatctcccagccattttcacatttaaataaaactcttgtttcacttaacaatggaagggctaaaaatttgcatattaagtgtgagtcagtggcatggatatctaattaaaaccatctttttccttttctccccttttcatttttgtcccctgagctgctgacattattgcaactgtattccgtggccccattctgtcagcctgtgtgttctgaggaaagcaaccaggaagggtgcaaggagagcaggagcttaagagaaggaggaggagatgtgatgtgtaactggggacaacaaaggcaaacacagaaggaactgtgatgggagaactggcacattggtgctggccaggaggcactattaatgcttaaaaagaggatgcaagggtgaagaagggagagcctgataaataaataaaaagtaccagaaaaaagagaaagtaaaaatggaagggaaggaaaggaccaaagacaacaagatgggtggagagaagcctgtagaactcacagtgagggtgatgctgtgtctttaagaagcaggtggctcaggagagaaactgcccgtgtcagcagagcagagggtggtgggtaaaggtgacagatcctctgggaaattcttgtacagcttcataaaacatgtctataatacatgaacatgtagagattgtcatcagaaagcatgtcttttggtcttgagtatctatccactttcctgaatagggttttatggtatcatttaacaatgcaggtgtgccccatatcctctcttttagatcttgcttttcttccttatagttcgcacagaaacatgactcagaaacagattcatctgaaagcatttgtataacttcaagatatagcagataggagggtctattcttcctctccccttccccatcgctaagaccatactaactaggaatttgtctacaattagctagaaatttgttaaaatcatttaccctgtatcttcctttgcttatttggttcatgaaacacgttacctatttaaaaaattctatgttgatggagaaaatcagcccttgataatggtagaaggtgagaagcatagcccacgttaggagttagtgcaaccatatgactattatggtgattatttctaccatagttatcatgacaaccatgcctcttggcatgcaagactgtccatctgtctgtgtacagctccttgggcagatataggctggaaaaagcaaaaatgttcagcaaatcaagaccaactggcaaatgatagttcccaaagggagaggtaaagaagaaattttgccattgaagtacaggccccagcgctatggcacccgggaccaggaatccacttagataaagggaaccatcccatttgtcaattttggcttctgttgcaattgcttttggtgttctagttatgaaacctttgctcatgcctacgtcctgaatggtattgcctaggtttttcttcgagggtttttatggttttaggttttacatttaagtctttgatccatcttgggttaatttttgtataaggtgtaaggaaagggtccagtttctgttttctgcatatgggtagccagttttcccagcaccatttgttaaataggaagacagtgtggtgattcctcaaggatatagaagcagaaataccatttggcccagcaatcccattactgggtatatacccaaaggattataaatcattctactataaagacacatgcacatgcatgtttattgcagcactattcacaatagcaaagacttggaaccaatccaaatgcccatcaattgtagactggataaagaaaatgtggcacatatacaccacggaatactatgcagccataaaaaagaataagttcatgtcctttgcagggacatagatgaagctggaaaccatcattctcatcaaactaacacatgaacagaaaaccaaacaccacatgttctcactcataagtgggagatgaacaatgagaacacgtggacacagagaggggaacatcacacactagggcctgtcagggggtggggggcaaggagagagagagcattaggacaaatagctaatgcatgggttgataggtgcagcaaaccaccatggcacatgtacacctatgtaacaaatctgcaccttctgcacgtgtatcccagaacttaaagtaaaacaaaataaataataaataaagggaaccatgtggatttacagcatgtaaagacaccagaaaacaagacaaaggaccatatggacaactgcttcaatgccctctggctcctactggaagttggcttgggaagctgttccctggacccaaggttaagttcaggagttacatatcctcttggagtagtgtttccaaattttgactaaattttcctgattatggaaatttttcaggttctggtaaaaattatatatttcatgtcccaccccagacctatcaaattggatgaggattatattaatatatttaatccaacaatgaggcatgattgataaatactaactcttagaggagctgaacaatttcacttgcaggggggccttgataagaccgagacaagacactgccattaaggcatgatggtctactgatgacttagtttccctgaggatgccaaagagtcacgtagttttcacactgttagacttactttaacatcagtgtcccgactcaatcctgatttgatgtatgaggtgattaagccactccagatctgcatttcacaacctattaccttcctcttcactgcttcttgaaatgtgactttaagccacagacaagataaataggcctatacttgggttcttcatgtactatatgcctaagagccaggaactagcatattgtcctcgaatgttggcttagatttgagtagtgttccctgttggcagaacataccgtgatgttaacttcctgcagttaacatagtcacggacatgagctgtgctcttcctcagttgccagcatgtccttgaaagtaattattccttgcatcctcaggacaactctatgacatagttctaatgcacatctctgttttccagttaaggatgctgaggcatagagaggaaatcaattgtctaagatcagagaggcagtgagaatcagaataggattcaatcccaggcatgcaagttccagactttgagcttttaaacatggaatttctctgcctcctctgcgatgctccatcaccatgcttttcccatctatgtgaaatgagtggttttcagcttgagctggttctgccctctgcagacaactgatgtccttttgctcttggatatctcatattgtgccaggcctaacaaggaaacctacggcatagtgatgaggcaagacccctccagctgctgacaagccctcaatcttagctcttctgagggaggcagcgtaacaggcatgagcagccatgcccagctctgctgctcttggcccctcatgtcaatggagcttagattgtctttgcagactgctcctctgctctttgcatggtgccgttcctattcctatgctgtcttagggctggcagagggaccctttcctcagctccctgcacctggaatcatcacatatctaccattagtccctaggggccttgtccagttttggttcttgttccttctccacctgactagcccggatctactttctggctgaatttcaaggtgtgctaccatgcacggggaagcacactcacagaattctgagagcatggcttttgcctgagacgcagaaagcctaaaatagtatctccataggaattgtacccacatttgaattcaaatccatttgtgtagcacgtaccacttcttctggctttcattttttttgagatttggagcaaccacatttttgcaaaatataaatgttcattcctcttcaaatctacagtgtcccatttcaataaagtcatgcactgtgtcttgatacacattattttaaaaccatcaggacttgggttcttcgggtcctatatgcctaagagccatattttaaaacatcaggacttgggttcttcggatcctatatgcctaagagccaggaattcaaattcgccctcaaactactaaacatgaaaattcaaacttccactacagaggaattgtagaggaaaattcaaacttcctctgtggaggggtcgtagagtataaataaagccaagtaatcttgacaaatgccaacatccttagacattggttttagacagtctctccttcaaaagttgtatgattcttctgtcttaaattgaatagatataatactgaacctgtagctgcatggcaaaaatttgagttgtgaccagtgtgtttccttgaatataatgaatgcatagtcagagtccatttaaaatgaaatagggagcatggaaacctatggaaatatactagggctgtgagaatcacaagaaaaaacagatgaccaatggcctttgttcttgatgtgtaggacttcagctggaccattaactctgtaaaatcttcaagttttatttctccttgaacctctaagctatgtaacatcactttatgccataatttaagtaatgttaccaccatttttcttttgatttgaaacggaattattgaaatagagtgtttttctcttcctttggtcactttattttgcagtcaagagttaaaatctataaaaatatagaatatgtttagacaaataattcatcatgttttctaaataatttatcgtgttgtctaaaaccatgaagttttcgattaaagaggtggagtcctagtcaatatattttgaaagtttttgaagagatctattcatgagtattgactgcaaacaaaaatgtcaaactgctgtgcatcagtgttttttaaaaaaatttaaaaaagtacagagtgtagcctcccattttcatatagcattgtggttttcttctctacctttggtagttgcttcaaggaatgacagagtggaagccaaaggtctaacaatggtctgaaacattgagtgccacctggcctggtcaccttcctgacctcttgttctatcattattcccctctgtccacttgagaccaaaagggctcttttctgttctttaccatagggaaaatactcccacttcagggcatggtattggttattacctctgcttggaatgttctttcttcagaaatatgcatggatcactccaatacttctttctgctctctgcccagaaggcttccgaatcactgagacattttctgatcaccgcccataaaacagcaacctttccacatcaccctggcatttcctgtacccacagcctgttttaatttttccatagcatttttcttttttttttttttgttcagcttttattttaagttcaggggtacatgtgccaggcatgcaggtttgttatataggtaaatgtgtgccatggtggtttgctacgcagatcatcccatcacctcagtattaagcccagcatccattagctattcttcctgatgctctctctccccactccccactccccactccgacaggccccagtgtgtagtgttccttgccatgtgtctatgtgttctcagtattcagcccccacttataagtgagaacatgtggtgtttggttttctgtttctgagttcgtttctgaggataatgggtttcagctccatccatgtccctgcaaaatacatgatcttattcctttttatggctgcatagtattccatggtatcacttttttcaccatcactcacacacacagagacatactgacacacactgaatattttctccagcatcattgttaggcttttaaattaagcagtgcatataaggtacctgctcatcgttattattgaggagaagatagctgatcatcattatggaaggctctgtagggcatcgtcaaacctatcctgatcttctctttgcttcttcctatagagaaaactttaattttctatatctatctgagagcaacctggtagcattttgtaatattgggttgagactctcttagtcttagatttgtagaactttataatcttggttctactttgttctatatgcaagtacattttgagtgtaacaaagcccacaaatcttttcctgattttgtttacatgaccttgaatttattgagtgatgagagctctgtcagaatcagatttcagagctccttggcccaagccaggaagtgggcatgcatgactgaccaagcccagagtggcaggaggccaacctgctgtgtcttatcttgctttcccatagctcaagaggacaagagcagtgttctaggagaagccaaattattttcctaacaagaaccataaagcattagaagtaatttcagaaaaatgtaagatatgtattcctataattctgacacttttaagagatatgactgtaaataaaacacattttacaaagggtgcatattaccagcatgctataaaatgcttctagaacttattttaataacatctcccccttcagacatatagcacttttactcttgagaccactttcacatccatccgtttatgctatctcacaacatagagagggaggacagcctggtcacgctcttgcacttgactgaggctctgaagagtatgatacgcacagcctctgtgccaggactgcagtggggggaattcagatttgtctttattccaggtcatgttgatgattaagaagacctgcccaacactgtccatgcctcagggacatgggctgatttttattcttctgatttttatgatgctacttctagcacctgtcgtagcacaaaatccatgatcagtaaaattccatgaaatgaatcaacttggcttaactatcacttagaacaaacttttttttttttttttttgagatggagtctcactctgttgcccaggctggagtgcagtggtgtgatcttggctcagcgcaagctctgcctcctgggttcacaccattctcccacctcagcctcctgagtagccgggaccacaggcgcccgccactacacccagctaattttgtttttgtatttttagtggagacgggttttcactgtgttagccaggatggtctcaatctcctggcctcgtgatctgcctgcctcggcttcccaaagtgctgggattataggcatgagccactgcgccaggccaagagcaaacattttaaaccactctatacaatattcatcctatataagcctcaaataattttacagtcctgtgtgagggtatccttgcaaaatgtgggtatgtgaaactaaaatcatggtaagctatcctgaagggaactgatgggcatatattataatttgatgtagttcttggattaaaccttcactttcaagtttgatttctgagcaaatgtcttcccccaacaaatgcatagttgtttcaacctcctcccctttatctctagggtatgtttcgaacatctcttttaaaacgttaatattctgagattgtagttgtcttattacagttttcagtataaatgtcattgcccttgtcactcttattcaattgagagctcctaaaagtcagagacagagtcctaatggatgaaggctcaataaatgttttttgggtaaaatggaacagaagggattacaatggaagaaatgaaatgaattagaataatctaagtgcaaaatgaatatccagataagctacaaagaagagagattcaaaggaggtgacaatgatgtaaactttgagaaaagcactccaggaaaaaaaaaaaaaaagtcatccacaattgttgagagagaaaatcctttgtagtcgaaatgtattccctgtagggtctgagcttcattctcaaagcacaggttgtgagaaattgagtcttaagacaattaatagcttcctcttgtttcttctaaaggaaaccatcaaagagtcttgaagagttacaggtgtcatgttccattcccatgggacacctctggagctggtgtttgtgttgacatggaggaaaggaagtttctgcaacaaatgttcagtttttgttttgttttttaaaaaatattataggccatttgtttggcaccctcttacagaatggccatgtcctcaccagtggatttaaattaaaaaatcatagaaatcttgcaagataaaaattctagagttcttttttttccttctgatgactgaagacactataattgttgagatttttgcctgccttcttcatgcagaaccatctttttagagaattattagggttttgtagacatcaatctggaaagaggcaggaaggaaaagaacatgagatagggagggaagaaatccctgtttttcttcccctgtcaaaaatagaagaaaaaataaatacactaggtcagtttttacttgaactcactctttgcaaagaaaaaaactttatttcatactttttcaaaatgcccaataccatgaacactactgaaaacagaagaaaaacatctatttttaaagaggtaattgttacgcagttttattataagtagcagcagatgaggcatatgcatgattcacagcagtatgggaagacaaacccaacacgtttcaactgacattgtccttcttgcatttacaaaagtattattgacaacaacttcttggatttgaatggaatctgacaacagagaccattatttctggggtcgaaggtgaccataacaagagatcataaagtggtttggcaaatcagaaggcctgtaaggctgccaaaggccttgccaggcagggaaaggcaccctacagggagcacagctggcaacagctgggacatggctcttaggaagctccagcagaggttgcccgtgctcccacaacaagcggaaattgttttgcacccggaaatcaaaacagatgagaaaagatgcacatgggagcagggtaggggcaactgtgaagcatgggataaacaagctcctatgccttgcatttggatcaggataaaatggagttgaacaaagcaaactatgtattattaatgttagtgttttctttaaagatttgatatgggcaagcacaaaacattgtaataaaaacggaaaggctcttcaaaattggcaattctttttcttcagttctctcccactgggatgctctgtgcatcttttctccccttctccttttttgggaacatttttgaacaaagaaatgggagtccaggaaggagaggggaaagaaagctgatagcagacacagaaagggagagggaaatataaaagctataaagggacgtggacagagacgcaggaggtgaaggcagcctggattaaaagctagggagaaggaaatcataagagaacaagagattcatatgcttctaaaatatttattacacaccctgggggatcagtgtagaaattgcattccctttgggaaaacatttgcacatatcctccttgtctggatataaagggaagagcatctcagcagctttccagatgggaggagggaagttgcttctttctggagcccttctcttccctcttcccgagctctacttttgtgctcattctactgagggcagtcatggcatcttccaccactaccgtagttctacagcaaaagtgtagttaccagcaggtccaacttcctatccaccaaggtttgctggagattccaccaccacactcaatttagcctcacagaaaaagacggacatgaaatatttactttttatggcttctttgttctcacatctggtcctggaaacaggcaatctagttctatgttgaatcacgttgaatgtgtcaatcatccatccagtatttattgtgaaactactatatgccaggtactgtgctagtccctctggagggccatcatccattcagtcatcaagtatttataatgtacctgtcaggtgctagatgctgtctactgaagcgttcatttattcattcattcaaaatatttactgagcaatttactgtgcaccaggcactcttctggaaattacacataggacaacacaaaacaaagtcccctgccctcatggtagggctgaaagacaataaataaatcctatatcatgcttttaaacgctattgatttgctgatgatgctcaaacctctcctctgaattcctgagtcacagattcaactgcctgcttgatttatctacaggaagccaaactgggcctctcaagcttactatgccccaaatcaaactgaatttcctggccccttctcaacctgtttcttcctcattctcccccagttaaaacaacaacaacaacgacaacaacaatgacaacaacaacactccattcttttagttgttcaagtaaaaaaataatggtgtcatccttgattccactctttctctcgcgccctataccccatacatcagcagatcctgctggttctaccttcagattgtgtcagaatctgaagctcactacctctacccccaccacatcagtgcagcatctatcatctctcctgcagttttgcagggcccttaactgttacctttgtttctcctcgcgggcccctcagtcatgcccaccttttgctccaagccctccaagacctcccttttcactcacagtaaaggccagaatctttaccatgggtctcaaaaccccatgtgtcctggccattgtcacctttctggtgacacctcttatactcttcctttattccctctgtcaagcctcaggctcccttaatgtcctggccacaccagttgcctgctccttctctggttgtgaccttctctccctgtgcaaatggctcatgctctcactcacttcagtgtctctactcaaatgtcactttacctgtcagactctctttgttcactggatagtaaaaaaaaaaaaaaaaaaaaaattaggtatgtcccaaaccccacctacaatatctccaagttcctacgatatctccaagtttcctttatactgcataatttgtcttccaacacctactgtcccagcatatgattccttcatttgccaagttgctgaagatccaccctcctccaccaggatgtaagctctttgtgagcaggacctttgtgtatcttggccattggtgtagaccccacccctagaacagtgcctcgctcaaagcgaaggcttagcatgtatatgttgaataaatgaatgaattaaatatgtaatatagtttcaggcaatgattaatgctatgaataaaaataaaacaagggaaggggaaagagagtgagtgggtggaattccagttaatataccatgagcccctctggggaagggttatttgagcagagacctgactgagatgaggtggtccgtgcaacaagtaggtatctgaaggcaggctgtccagccgagggaatccacactgtctgagcaaggagcactctcgggaaagagcaaggggacccctgtgcctagaagataagcaatggggctggagcatgagggagagccacagggctgagcacatggagcagtccaggccattgtaaggagtttggattttattcttagtgtgttgggaagctgtaagtgcttttggagcaggagaaggacatcagctgactcactctttaaaagaatgaatctccagggcccgtgatgagcacaccgaggggaacaagttagggcaggaagccagtgaggagttgctgaggtcattcttggggagagatgtgcgggcctcaacatcatgggagcatacacgtggtgagaaagagttgcagctggaattatcttaaaggtaagccaggctttgctaacagattggatttggggtgtgagagaaagagaggactcaaaagtgagtccgaggcttttgaactgagttcctgtgcacatgtagtgacttttatcaaaatgaaggaaacagagggcagtttgtagggggaaagtgagaatttggcatatacaggacaaacgtgaaacatctttagacacgggagaagacacaggttcttcatttcttttttttttttttctttttttttgagatagagtctcgctctgtcacccaggctggagtgcagtggcacgatctcggctcactgcaaactctggttcacgccatcctcctgccccagcctctcgagtagccgggaccacaggcgcccgccaccacacccggctaatttttttgtatttttagtagagacggggtttcactgtgttagccaggttggtctcgatctcctgacctcacgatccgcccgcctcggcctcccaacgtgctggaggttcttcatttcaaagcaaaggtcaggccggaagatggaagcgtggaaggcatttgagtataaagcacgtttaaggctctgacacccagtaataccagcaagaagtgagtgcagccagagaggatggccaggcctgagccctggagctcttcaccaagcaaacattgggagaaaaggcagcgcctttgagagaaacctcaatggcagttccagtgaagtaggaggagaaccaggagagtgatttcagggtatggaaaataagtgatttccaggagaggtgttgataagtaggatgcagtttctattttcaaggtgctcttgagcttgtcaaaagagattacagtatagcaagcagaaggaactacaagagaggtgagaagagggcacagtcatgagcagcatattcatgtcaataatgggccacagacaatgttcacaatagcaaagacttggaaccaacccaaatgcccatcagtgatagactggataaagaaaatgtggcacatatacaccatggaatactatgcagctgtaaaaaaggatgagttcatgtcctttgcagggacatggatgaagctggaaaccatcattctcagcaaactaatacaataacagaaaaccaaacactgcatgttctcactcataaatgggagctgaacaatgagaacacatggacactgggaggggaacatcacacagtggggcctgtcagggggtgtagggctaggggaggaatagcatgagcagaaatacctaatgcatgcggggcttaaaacctagatgattggtggatggatgcagcaaaccaccatgtcacatgtatacctatgtaacaaacctgcacattctgcacatgtaccccagaacttaaagtataataaaataataataataataataatgggccacagacagaacggtggtcccataggatcctaaaggagctgaaaactcacagttgcctagtgacatcacggctgtcctaaggtcttagcacaatgctttactcatatgttcctggtgacactggtatagcccaaccatttgcactgccagttgtgtgaaagtccagcatgtataattacatacagcagaaaatatttgacaataaacgatcgttactggtctttgtatttactataccacactttttactattattttagatcatactccttttacttatatattttttaaaaggtaactgtaaaacagcttcagacaggtccttcaggagggatcccaaagaaggcattgttatcacaggagatgacagctccatgtgtgttactgcccctgaagacctcccagcggggcgggatgtggaggtggaagacagggatagtgatgatcctgaccctgtgtaggtctaggctaatgtgtgtgtttatgtctgaatttttaaaaaaagagtttaaaaataaaataataatacattttaaaaattggaaaaagcttaaggaataaggatataatgaaaatgtttttgtacagctgtataatgtgtttgtgttttgagctaaatattcttacaaaaaagtcaaaaagaccttttacctcatttcactcctgagagcatgtttggtcaccagctggctgtcctggagccaccctcgaaaattccaacagggttctcgttcttgtcgcttctgctcaaaccagcatggtctgacctatgtgccactggtgtttctatcagtatggaaaggatacaggtttcattaagatggacaaagtgatcttccttgaaaggattatccaagggatctacccaatgaaaaccatgatacctctttgtacttaaaataaacattttctaagtcaaaaagttaaaaaaattatgttggtaaagtaaaatagttgttagagtaagataagactaatgtatgactaaagaaaaaatttaaacaaaaataaatttagtgtagcctatgtgtggagtatggtaatatcccaggccttcacattcactcaccactcactcactgactcccagaggaacttccagccctacaagctccattcatgataagcaccctatacaagtataccttttcatctttcaggctatatttttacagttccaattgcttacagtattcagtacagatttgtaccctaggagcaataggctataccatctagcctagtgtgtagtaggctgtgccatctagcctagtgtatagtaggctgtaccatctaggtttgtgtaagtgcactctagggtgttcacacaagaatgacaccgccttcaacacatttcccagaagtatccctgtcattaagtgacatgtactgtagtatggtatttcagttatttgattactttgtctatagggcaggaggtgatcaaagaatgcttcacacaagactgtattttcacaaggcctcttagaagggtaggtgttctccaggtaaagaggaaccaggttttcctggcagagagcagcataagcagctgcataggcatgcggttggggaggcccagggtggctgaggcatcaaatgcaaagaggcacatggcaggagctgtggctgcaaaggtaggctggagccaactggatctctgcacatccagcagaaaaacttggattttatcttgtaagcagtgaggagaggatagagtaaattaaacctatctacatggatagaaatattcaaggcatagaagtaatcaaattgagaaggaaaaactaaaatgcatattagaaagcagtaatgcaatactatgattgagtaagataagaatcatggccaatcgtgagtgatgtgcataggcccactgcttaatggccctgagcttcaatgtcctcagctacaagcttgctgagatatcttccaactcaaagcatttctgtgactctatctggccaggtaataagatcagggaatatttcctggaggaggaaaaccccaagctgggtcctaacgggaaagtgtcattcatagtagcaaagaggaagggagaggagagtctactaagggaagcatcacgagaaaagcaagaatgaggtgttcgtgcagcaaacagcaggctgcatgaagagaggaggcacatttgctgctcaccgttactgtagtccagggcctcatcagcaatttgctcccaataaatgcttgttgaatgactgtgggaacagataaatgaagaaaagtgggttggcccatgggtatgttggagattatagcagatgatggcccaggtcagcagggacttgatcctataggacccgggaggcaatgaggcagtgacatgttggaaattcctaaagggacagaagagacgttgcccgtcatgggcacattttagaaaattctgacaggtggatttgtcattgtacatgatgggctgagtaaccgtctctcagtgacccgagtcaacctgtttttctttatgtagcaactgttgtttgtttcagggtgaaaaatcctcactggagatgagagagcccagctgtgtttgggttttacaagctgtctcaagatttttctcaaatgttttggtttatggcaaagttgaaaatacagcattatcatgatccttattaccattatcatttattcaactacccactaataattaatgtttactaagtaccaataatatgcaatgagatgcaataagcattgaattgctcttggcctctttccagtgggcttgttgtaaataagaaaagaatgagttaccacccaaattttaattgcttcaaaatatgtttgtttcacaggctctccttggttaagctttgctaaactgattgaaaccaagaatgctgactttaggctagccatccgttttataccaacatttcccaaaatatgttgtgaggaaaggatattgatagatgatgtgtaaaaaaagagaaaaaaaggaaagaaagaaaggaataaagaaaaaaagaaaagaaagaaaggaaaattaaaaaagaaaaggaatcccagaaaaataaatttatgagacaatggcttaaataaaagtaaatatgttccttactgcaggattttggtggggtttgaatgggtcaatgtgcctagcaagcaccgagagaggaaaatattccaaacttatttgagcagggaatcattttctaaaaagattataaaagtatggtttaaaaaaaactgttctgaagttcaaaatgcattttttttaacaatgaagaaattgcatttgtcaggtcccttccctgtcctctcaattcaccaaaaccttggtggcacattcttactatcatcaaagaaccattgtggggctcacaaatgactaaccctaagataggtgcatcactccttcatgctgggtgacacgtatgctgtcaacagttggttgaggaaaccctctgcagaatccccacagcactggggccacccacacaattgtatgagacatgaggagagtcattttcactgcagtataaagatttgaggaccaagcttttatgagtattaaggcaattggaatccttgactcacactacaatggctaaaataaatgtgactgacaatactaagtgttgacaaagaggcagggcaactggaactcctgtaagttgataatcactgcagagagtttaaaacagggtgagcactttggaaaactgacactttcttcagaggctagccacacacctatactgtggcactgcaattccactcctaggtatttatttaagagaaatgagtggatctgtccacaaaaagatttgtacaagaatgttttatttataatagttatacagggaaacagggtacatggactaccattggaagattgggtacacaaatgatgctgtattcatccatggaatattactcagcaataaaaagaaaatacgcagttttatatacaacatggataaacttcaaaataaacaaattaggttaagcaaaagaagccagccacaaaagattacatagtatatgattccattaatgtaaagttctaaagcagtcaacgctaagtcatagtaggagaaattgatcagtggctgccttgacatggggtggcaggagccacatggtgggggaattgactggaccagtcctgaaggagttctgtgggagaaaggaaacatgctatttcttaactgggaggtagctacttgagtgttcacgcttgccaaaacacatcaaactaaacacttaaggtctgtgcttttggttgtatgtaaattataactcaaaacaaacaaacaaacaaacaaaaaacacaaagaaccgtgaattggaaccccctctctcctacagcactgtgagacctgttagctcctgccccagtcctggactgtcataaacacttatttatgaggtaaatgcatgcaatacaaagtaacttgcttgtcatgagtcgggggacagtgttccctttcatcatttggaatgaaaatttttaatacctagacactaattcttaggtcagtttggacagctctcccgaacagtgatattaagaactaattcttttttattttattttattattattatttttttattattatactttaagttttagggtacatgtgcacaatgtgcaggttagttacatatgtatacatgtgccatgctggtgtgctgcacccactaactcgtcatctagcattaggtatatctcccaatgctatccctctgccctcctcgcaccccacaacaggccccagagtgtgatgttccccttcctgtgtccatgtgttctcattgttcaattcccacctatgagtgagaatatgcagcgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcgttgttggacatttggcttggttccaagtctttgctattgtgaataatgccgcaataaacataggtgtgcatgtgtctttatagcagcatgatttatagtcctttgggtatatacccagtaatgggatggctgggtcaaatggtattgctagttctagatccctgaggaattgccacactgacttccacagtggttgaactagtttacagtcccaccaacagtgtaaaagtgttcctatttctccacaagctctccagcacctgttgtttcctgactttttaatgattgccattctaactggtgtgagatggtatctcattgtggttttgatttgcatttatctgatggccagtgatggtgagcattttttcatgtgttttttggctgcataaatgtcttcttttgagaagtgtctgttcatgtcctttgcccactttttgatggagttgtgtgtttttttcttgtaaatttgttggagttcattgtagattctggatattagccctttgtcagatgagtaggttgcaaaaatttcctcccattctgtaggttgcctgttcactctgaaggtagtttcttttgctgtgcagaagctctttagtttaattaggtcccatttgtcaattttggcttttgttgccattgcttttggtgttttagacatgaagtccttgcccatgcctatgtcctgaacggtaaagcctaggttttcttttagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtaatgtgatgcctccagctttgttcttttggcttaggactgacttggcgatgcgggctcttttttggttccatatgaactttaaagtagttttttccaattctgtgaagaaaggcattggtagcttgatggggacggcattgaatctgtaaattaccttgggcagtatggccattttcatgatattgattcttcctacccacgagcatggaatgttcttccatttgtttgtatcctctttgatttcattgagcagtggtttgtagttctccttgaagaggtccttcacatcccttgtaaattggattcctaggtattttattctctttcaagcaattgtgaatgggagttcactcatgatttggctgtttgtctgttgttggtgtataggaatgcttgtgatttttgcacattgattttgtaccctgagactttgctgaagttgcttatcagcttaaggagattttgggctgagacaatggggttttctagatatacagtcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttggctctgtttatatgctggattacatttattgatttgtgtatattgaaccagccttgcatcccagggatgaagcccacttcatcatggtggataagctttttgatgtgctgctggattcggtgtgccagtattttattgaggattttgcatcaatgttcatcaaggatattggtctaaaattctcttttttggttgtgtctctgcccagctttggtatcagaatgatgctggactcataaaatgagttagggatgattccctctttttctattgattagaataatttcagaaggaatggtaccagttcctccttgtatctctggtagaattcggctgtgaatccatctggtcctggactctttttggttggtaagctattgattattgccacaatttcagatcctgttattggtctattctgagattcaacttcttcctggtttagtcttgggagagtgtatgtgtcaaggaatttatccatttcttctagattttctagtttatttgcatagaggtgtttgtagtattctctgatggtagtttgtatttctgtgggataggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgttagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcgggttgttcagtttccatgtagttgagtggttttgagtgagattcttaatcctgagttctagtttgattgcactgtggtctgagagatagtttgttataatttctgttcttttacatttgctgaggagagctttacttccaactatgtggtcaactttggaataggtgtggtgtggtgctgaaaaaaatgtatattctgttgatttggggtggagagttctgtagatgtctattaggtccacttggtgcagagctgagttcaattcctgggtatccttgttgactttctgtctcgttcatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaagtctgttttatcagagactaggattgcaacccctgcctttgttttccatttgcttggtagatcttcctccatccctttattttgagcctatgtgtgtctctgcacatgagataggtttcctgaatacagcacactgatgggtcttgactctttatccaatttgtcagtttgtgtcttttaattggagcatttagtccatttacatttaaagttaatattgtttaaatgtaacatttacatttaaagttaatatttaaagttaataattaatatcaaattgtgaatttgatcctgtcgttatgatgttagctggttattttgctcattatttcatgcagtttcttcctagtctcgatggtctttacattttggcatgattttgcagtggctggtagcggttgttcctttccatgtttagcgcttcattcaggagctcttttagggcagggctggtggtgacaaaatctctcagcatttgcttctctgtaaagtattttatttgtccttcacttatgaagcttagtttggctggatatgaaattctgggttgaaaattcttttctttaagaatgttgaatattggtccccactctcttctggcttgtagagttattgccaagagatccgctgttagtctgatgggcttccctttgagggtaacccgacctttctctctggctgcccttaacattttttcctccatttcaactttggtgaatctgacaattatgtgtcttggagttgctcttctcaaggagtatctttgtggtgttctctgtatttcctgaatctgaatgttggcctgccttgctagattggggaagttctcctggagaatatcctgcatagtgttttccaacttggttccattctccccatcactttcaggtacaccaatcagacgtagatttggtcttttcacatagtcccatatttcttcaaggctttactcgtttctttttattcttttttctctaaacttcccttcttgcttcatttcattcatttcatcttccatcactgatatcctttctaccagttgattgcatcggctcctgaggcttctgcattcttcatgtagttctcaagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccgtccagctttgttccattgctggtgagggactgcgttcctttggaggaggagaggcgctctgctttttagagtttccagtttttccgctgtttttttccccatctttgtgttttatctgcttttggtctttgatgatggtgatgtacagatgggttttttgtgcggatgtcctttctgtttgttagttttccttctaacaggaccctcagctgcaggtctgttggagtacccggccctgtgaggtgtcagtctgcccctgctggggggtgcctcccagttaggctgcttgggggtcaggggtcagggacccacttgaggaggcagtctgcctgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagctttctggctgctttgtttacctaagcaagcctgggcaatggtgggcgccccttccccagcctcgctgctgccttgcagtttgagctcagactgctgtgctagcaatcagcgagattccgtgggcataggaccctccgagccacgtgtgggatataatatcctggtgatccgttttttaagcccgtcggaaaagcgcagtatttgggtgggagtgacccgattttccaggtgccgtctgtcacccctttctttgactaggaaagggaactccctgaccccttgcacttcctgagtgaggcaatgcctcgcccttttttggctcatgcacccactgacctgagcccactgtctggcactcccttgtgtgatgaacccgttacctcagatggaaatgcagaaatcacccgtcttctgcgtcactcaggctgggagctgtagaccagggctgttcctattcggccatcttggctcctctccctattaagaactaattctgtgcattttgttttgatgtgctctatctccttgtgaaaaaaaaatgcctgaacatttgatacatgttcagctgatgagtagtcctttatttttcaattaggataatcactgacttttatatttaacccaaattatattctcttggtctcagcatacgttttgcttcttcactggtggatgcagcctttcttcagcctcttgaagcaaccatgggtaataagcgcaactgtaaatcaaaaccagttaatcttagaagccaaagaatgaccacaaacaaacttaagaactttactaggctcaagcagtattatcttgatgataaagacaacagttatcaactattatttaacaagtcattaaatggtaagtggaaaggattcactcaccatgttcactgttgagtttagaacatctgtatttttgttttctatttttaaggactttattcccccaatgttgctgttagatttttgcttagaacaagaagatctttgatgtgaatgactctttggggggctcatgttaaggatgtgttgtgtatcccgttatctgtctcttcacttgtcttcctgttcttcatctttctcatcttcctcttcctcaccatcatcatacactgcacttattaagcacctactgtgtgccagccactctattctctgtactttcctttgcactgtttcattgaatcattccctatcttatagttagaaatggtattttaacctattttaagcttgaaaaattgagatttagaaaatgtatgtaaattatggaagaacacagtttaaacttagaacaattggtatttgattctaagtctatttgaatacagccaaatttattatatactgtattatatcatttcacatgccttgaccttcattttagcatagttaatcttttactttacatgtgagtatattctgcaaacttgctgaatttctaacttgctaattgtcttcaactttaaataccttccattattttacttgaaaaccctccatatatttaaaaatgaataagcaattctatttgctattatctcagaaatatatgcatacatttgataaagtatttcccttttagatatgttttcaaagggtcttcatctgtaaatcaaaatctttacaagtaaattactctatgcaccccaagagattttataatgaaaataaaaaataagtagacaggtaatactctttcctaaagtcaatgattaccttaatacatcagtctatgttccctgtctttgggcattacacctacaatacacagcacctgagaataaaaacacagcacacactccagaaaaacatatgttcattcccgatgaatttgcttctgtcttgaactttgcctccattcctcatgttggaggttaagagtgctctcctctctcaatcttacatttaaaaacagggacagctttgccctcttctcttagccatatcttgactgttccaagctttccagaatgacagttgcttccaacacagaaggtatgcctagccccagaaggcttcccactccaagaagcatctcactccaagttcggctggactgataacctcttccctctttcctgaagtcctcatccccagtgtgctactacctgtctcagtctgagatgaaaggagacgtctgtaccactgtgcaggaagagtggattctctgtggctctaatccctgtgtacttctggaactacctggtgcagcacaggctaactggggaaaagaatgtgcagccaggaatgtgttgtgggccagggagcttgagatgggtgtatggggacttggcttcaagagccatcttgggcaactcactctggctctgagtcctcatttgaaaatcattgggttgcactctgttatctgtggtctccaacctgggaaacctgggaaccacagggtgaacatgagagtccatgtattattgccagtgtttaaaaatcttataaaagcccaaagataagtggtcaatttacctatttttgacaaaaatcatattaattcagcataatggatactcagattaaaaggacacttgcattcaattttaaaaattgggaaaacaaatgcaatttgtttagtagataaaatatttcaaacaatgggattcatggaagtaacactttttttaattttttttaatttttttattattatactttaaattttagggtacatgtgcacaacatgcaggtttgttacatatgtatacatgtgccatgttggtgtgctgcacccattaactcgtcatttagcatttggtatatctcgtaatgctatccatccctgctccctccaccccaaaacagtcccctgtgtgtgatgttctcattcctgtgtccatgagttctcattgttcaattcccacctatgagtgagaacatgcggtgtttgggtttttgtccttgtgatagtttgctgagaatgatggtttccagcttcatccatgtccctacaaaggacatgaactcatccttttttatggccgcatagtattccatggtatatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagggaagtagcacttttttaaaggtggcttaatgctgagaaaagctatatgatttctaagattttttgaacttcaagagtatggctctttgatttgaaatttgcatgtaaatatagtgtacatgctaaaaacatgagagtgtgtatatgtatcttacatagtgctgatagcgtcaagtacttttaaggattctacacatcttcacaataaccatttgaggtagatactcttagcatctccatttcacagatgagaaaactggggcgaaaagaggttaggttacttgcacagggtcacacagatggatttgtctgtgtgtcactctatcataaatgtatacagatgaaatatctgtatatatacctgttcatatgtaacgtacatttgaattcaatagccatacaatgtttggcaaaatactgcatgttacatgagttttctgtgctgaaaggaggtgtattattagtttgggcaggctgtcataagaaaatattacataatgggtagcttaaacaacagaaatatttttttttttcacgtttctggaggctggaagttcaagtgcaaggcgcatgcaggcctggttttctttgagatatctctttaacttgcagatggctgccctcttgcagcctcttcacatgttcttttctctgtgctcctgcatctctggtgtctctttgtgtgtcctaatctcatctaataaggacatcagtcagattggatttggcccaccctaatggcctcattgtaacttaatcacccccttaaagaccctgtctccaaacagtcatattctgagatgctggaggttagaatgggggtggggcacagttacagttcagcccatagcaagaggttaatgaatttcttgaagcagctcttcagagttccatgtatagcacacattttaaaatcgctccgaataactcctttgtttctgtacactcactgactcacttaagaaaaatgcaataggagaagaggagaagcaagcctatctaataactggagatttaggccagccctcaggccttcataggtcttagtgggggcttatgtatttggagggctttcataaagaactctccaaaacccaacctttgcttctctccagtggaatctgttgtgactcaggcagggacctcagggctggtggagagaagggaagaagaaagcacagaaacctagggctggtgaaataactagcagtatggcaggtgggagcagtatttccagtaatggtaatggagagaacatggcagctgtggctaagaaagagggtgctagaacccaagggggacagttattttgtgaccaggggattatgcctttcatcaggtggccacacagttgaggtgccaggtatgactaggcgttttacaccatagtgactgcaatccacgactttggaagacaggcccacaggaaccagatatgtgtcctggttccaataacatatgctggttcagggtggtgctccaccctggtgaggacaggagcataaacagggaactgagacagaagaccagctatatgaatgatggatagcaacaatctgttcaggaagggaggctagaagttttccgcagtggccagccatttgggggccactgcagaaaaatttctggttcctccaaatagtgaggcctgagattctgagaacacattcaatcttgataagggagaatgtgaggctgagctgggcagatgcaaagggtgcatgtctttgctacctatcacatctggggccagcaaggactgaagaggacaggccacagggtcactgagaaatgcctattgtttcatcttcctgcttttccatatcccctgggctcttttcgctcctatgtgaagaggtccaattcctcttaatttactctctccttgacaacagattccagaaagcattctgttctggtagcttctccttgcaaattataaacagggtaaaaactgggccaaggaattgacctggggagcaaagctacaaaggcaggaggcaggctacctgacccaatccatctctctctatcactaatgtttctgactctgtgattatgattttatgaatatgattgctgctgcatgttgggtctgtctgctggtaaatgtaggccagtcgtcccctcccacaggcccgagcaggctcctctccatcagctgaagtccttcatctctcccatccttcctgctacgtgttccagggatggctcagctacatacctgaggcctggcaagttcactgatggctcctgcaggtaattggccttagattgtagagagtgctgttaatttctctacaaatacagtgttctgtttggattttcatctgtgccatgacttttgggccttatgtaaagccattcctttacgtagttatggattatgatttttttgtgtgacagagtttcactctgtcaccaaggctggagtgcagtgacatgatcttggctcactgcagcctcgatctcctgggctcaagtgattgtccagcctcattcttctgagtagctgggaccacaggtgcacaccactatgccctactattttaaaaattttttgtagagacagaatccagccatgttgcacaggctggtctcgaactcccaggcttaagtgattttcccacctcggcctcccaaagtgctgagattataggcatgagctactgcaattatgaattttggctccagtgatagtggagaagcacctactctgaaaaatgcagtctccttgtcagtttcattatttcatgccctgcaccaatagggagggaaatggatccttgacctagttaggtttccttagtgatcactctttcatatttgtggaattggtagggctgcctcacttacagattgggtctttccccataagggagtagcatccagaagaggtagtttctgtgtccacagtagctcgagggctctttttctgtccttcaattgattttcttccttttcatgaattttcacacattcacaaatttattttcacaagttttcacaaagctgcacattggctgggaatctgcccctgggaatggctttgccaaaggtcattcacttggcatttgctgtttggcaccccttgtccttaatggaagagttgactgatttgaatgagaatttttcattgccgtgcattaaacagctgttctctctaaccagatgcttaatatggttcctcttccaagcctagtgaagggagctggctcgctagtttgcagttgagagaaatgatctaagagcctaaggatacatagaaagaatcccctggtggtttggggtaaaatctccttcttgggttaacattcagagcatacgaggcatttttaaaaagtggcctgttgatttgatgaaactgagatgtcagcgcagcactgtgaggtagtgagaaagatacaaatgccatcaggccatgcttccactgccccctgcagtgacgatgcacagagcacttgtgctggggactgtgggtcccagtggggagagattgttcagtgcaagctccactctcccacacagttcctgctgctggaagctcacctccatttattccatttatctgaagccctggccaagctgcaagctactgtgacccagttaccatggagaacttgtatattcttggcttccttgctgcttttacaggcagaattacagaagagaatgtctttgctgctaggaaatataaatattacagagagatgctcattttctccctctatgatgattattaccaaagatatgcaagaagacttcattacagaacattgtccttcataatgagccttccgtaggcttttacagggatggataagcctgccagaaatggattgtgttaaccctcggctctctcctgaatagacacaaactagaaccatttgcacatttagcagatttttgtggagtgcttactatgtgctaggctctggtgatacagagacaaatgagatactgtctttgccttcaaaggtcttagagtctaataatggaagctagaactccaaacaaaaacacatgttgcaatgactttcaccaagtgcagagaagtatttaaaaaggtagggatattccctttatgtgacatgtatgtatgttggttattacatatttgtcaggaagacgactgaagaagcacccccaagctgagtgttgaatgtggaatatttgttcaccaggaaaagggagggccttccagaaccatctttagcaaatgagttttgccttcatgatgtaggcctgctgctactcctccaccgtgtctgtgtttcagacaaggaaaagagggtgagggaaagtgaaggcaaatggaaaagaggcacatgtcagctgagcctgctttcaatgtgggctggagttctcattgaatgggatgggctcttgagctacaagagagcctagattgttgagtgtatttagctaggtccgtggctatccttaataaaattaggagttgctcaataaagagtgggtgtggttgacagcctccaagatggtcatgaatgattctcaactcctggaatgcatggccttgtgtcatttcctctgacactagttcatttacagcgttgcagcttctgtcttggtcttttgttgtgaggataattaggcagccctctggagacacccacagatggaggaaccaatttccagttgcgagagtgagccaacttgaatcaggtcctccagccccaagcaaactttctgatggttgcagccccagctggcatttggccacaaccttataacactgagacagaaacagtcaaccaaggcattccaaatccctgacccacagacaccatgagagacaacaaatgattactgttgttttaaactactaagcctggggtatgcagcaatagataattaatagataactgagtcaagaggagaacaggagcagtacctgaagagcagatgactagaaggctgtgccccaccatccacagccatcccctgccatgtagacaaagtgcctcacctgccatcaaaccccctcctcccagctgtgttttttggcctcacctttcttccttttctcaagcaacttaccactcggctgaaactttatcaagggctgtattgaataatgcgttaccaaattcatcgatcattttttgatgctcatttaactggaaacggttgctcatgagcttcttttcgaaccacttttcttgacttctaggacctcacattgtcatgggttctttcctgcctccaagaaacttgttttcagttctatctgaggttctcctttttcttcttaattcctaagtgttggcttattgaagagtcaggtcctagaacgccttttcttctgtctctactttttaataaataatcctaactggtcttctggctttacacatcagcgatatgatgctgactcacaaattcatatttagtagaatggttaagagcatgaacatgggaaccagacaatctgggtttcaatcctagctctgtcacttggtaactggatgaccttgggccatttacttaatctcagtttcctcatttctgtagttaggatgctaatgatatctatgatcacacttaaggggtactcaacagacatgagtggcttccactgctgctattattactgcttttactattgctactgatattcctcaaacttcaaacacattcatgcgttcatgctcacatacgtgtcaaatctgtctactgggcatctctattgagtgtctagtagatatctcaaatttaagtccaaagcagaatcctgcattttcctgtgaaccttacatagtttctgccctaattcactcagtctcagtgactgacacggctatccatctcattgtagcacatagaaaaaaatctaggtgtcattcttaattcttcaccttccttcattttgaatagctgatctagtaggaagccctggggtccttacccccagaactcatcccaaatctttccttgtctctccctctcctgtactgttgccaacatcctagccactggtgcttcctgccttaactacaaacatgccctctgcaccctccatgcttccatttttgcatcccttctgcaacaatgtgttctctattcagtagtcatcttttaaaaacaaagtcagatcatgtcacatcacttgcaaggtcaaaatcctgaaatgttgtctgagagcactttgcatgaaattcaaacatctcttgcaggactgggccttaaactacctgtttggcttcttcttatgaccactaccatcccccaccacaaacacacatacacgtacacacacactcacacactccccccacacacatacacacatatacagacacatacctacacacacacacctcccacacatacacacccccacacatacatacacacacatacagccccccacacacatacacacaccacacaaacacacacacacccctccacacacacacccctccacacatacacacacactcacacccctccacacatacacacacatacacacacactcactcccctccacacatacacacacatacacccccacacatatacacacacatacacccccacacacatacacccccacacacatacacacacaccccacacacatacacacatgcctatacacatacacatacatccatacacatatacacacacacagatacacacacacaccccacacacatacatacacacacaccccacacacatacacacacatacatacacacacagtcaccacacacacacaggcacacaggcaccacacacacacatacattcacacacacatacacacatacacacgcacccccacacacaaacacaccccagactcacatacactctctcacacccacacatgtgtgagccctgccctgtgcttgctctgctctagtctcacgaaaattctctccatgtcgcacccagttattctctaaagcatcaccttgtttcacttttaaattgtgattttgtttttattttcctatcttttccctcttattttctttttgcttccaactccctcactagactataaatttcataaggacatgtatcttacatcttttattgattgatgaattcttggcacttaaaacagctcagaacagagaaggtgttcaacacatttgtctaatgaataaaattcagaaaagacaaaagcagttgtccaagaatatttctagagctcttactaactggtttgggtagtggttactttcaataacatacagaaggcaagataattggaggtgaggcaatgagcataattctagacatgttgagtgtggagtgcctgtgggatatctgggtgtgattggatcagtatggatgagatccatgattttagagtgcaggagagttctgggaggtatatgtagttttgagatccaccagcgtttaccataaatgacctaatttagtttgagacttttccctaaaatgagcttccagaaagaggtagagctgctttaccttaaagtcctcacagagcgttatgtaatctaaaatgctctcttaattacttgtttagaacaataaagtaatgttttggcagatacattaacctgaaactacctcaatcaatactcatttggaatacttgggatgttttctgaaagaatcaatttttttaaaaaaggctaaagatttttaacattgatttaaataattatttttgtagctgcagtataacaattacaagtgttaggtattactgtaacaagatttttagaaatcgttttaaaaagcaacataacgagtgcagatcacaaacctctacaatccatacaactctatgaaaaatgaaaacaactaacattttatgcaaaaaggcactagttgttcaggattgaatttccactgataggtatcttgagaaaggatgggggtatggatagaaagtgtgcatgcttttataattagtttgcctgcagagggaaggagaggtgtactttggctacaggggcatttacaatgtaaggagttgtttctaatgataggaaagcactggccattcacataggttgaagaaaaagagccagaggagagtgagcagtttagagatcaacaagagctgaagcatgagtaaaggctaagcagaaagagagggaggctgggttggaagcccagataggaagattagctttgtccaaatgaaggagtacgccttcctttcaacctgtaggtcacaagattagggacacactgtaggtttgtcagcgtggagatcagaagctagagggatgtcaacagcctccttgaacgcatctattcaaccttgctgttcaccgtgacaccaaacactttgccctggagttgtcagctctcctggcttttgaatgcagcttgaatagtggctggaagactctgaactttgaattcagaatctttgattctcatttggtttcatagaccattatcactaagatttgtgagaggctgtgatctccacaattcttgtagtaacatgtgaggctccctttccttctgacccagaaacccctttctcacagtgctgccttggggagagggaggagaaagttcatttccgcactcagtattctccagtgagcataccctcatggcatctgggcgttggtgtgccagccttttaaatgacagcattaaactgcatctccagatccacttccaactcttacattttaaacatctataaacacttaactcacatgatgcctttaaataataaaacaaggtggaatataattaaggggcaaaatgagttgtacagacaatttgtgctgtgagcagtctttttaagttgactaatgtgacattgttctgcaggaaaagaaaacttcagcattttattttcagaactacctgacccaaattaggtaactggagtgtgaggagggaggattgaaaaagtcccagagcacctctcaggtgacgggaactcttgctttcctttgtaatcccactgaagggagacggaaggctagaggagcagggctgcacagggactcggcttctgtccaaggcgtcattcctgcctgcagaacaatgagccttcaggccagtggacgagtctgttatcagcctgcagcaggctgagaaataatctccagccactagcaacaatgggtgccgtatctcaggccaggtaatgaggagtctttaaactgcatcagctcgattttattatcctttagttttacacttctcagcctagaatggtcttatctgttcctttttgttgttctgtggaaacccctctccctccacaaaggaaaagatattaggtggcctttttctttccttcttttttcaaatttgaagccacagcattataataaatctctataaaaatacacataagtgcatgcataattaaaattacctgcctcagtttcttttgtgcaatatctgatccaaaatggatgaatgtgtaccaaccacattttaatgacacggacccgaggctccagccccgaatgcttattggggtcctgattagggagcagatttatctatatccaggcaaaccctacaactcctcggctggaggcacatcctacaccagcttttatatgtgctcagagacatcaaggaagaaagaaaatcttggactgcccaggctagctgtttctatcttgctgattcagtccaaagtattaactggttctttccatgcgtttctcttaaaagctgttttttcgttccaacaaacattgaccaggattgaagcaagcttttttttttttttccgagacggagtctcgctgtgtcgcccaggctggagtgcagtggcgtgatctcggctcactgcaagctccgcctcgcgggttcacgccattctcctgcctcagcctcctgagtagctgggactacaggcgcccgccaccacacctggctattttttttttttttttttgtatttttagtagagacggggtttcatcatggtctcgatctcctgacctcgtgatccgcccgcctcggcctcccaaagtgctgggatgacaggcgtgagccaccgtgcgcggcctaaacaagctttatgtctcatacagaatcattcagacttgctcccatggagcctccctgtgccattgtcttctatcaggagacattccacatgagtctgaaagggaggatggccctggtaggaaggggagttggcctacttaagatcagaatttatttctctatataggtgtgcattggtggagctctgcatcaaatgattcctaattcacaagaatgaaaaagacaggaatgtgaagcagtgagctgaatacgtgtcaattagcctatgatcccttttagtttctcaactttaaagataggtataggttaatcatgcaaaataaagaacttggttttatttttaaaacgcatctggaagacttcaaagtgaattccaaaaagagttaaacataaaaatgaaaaagcattaaaaagtatataagatatttgtataagtgtgagtttgggaataactttgtaattaagactcaaagtgcagaagttataaaagcagctgacagatttggcaatgtcaaaaaacttattacagtgaaagagattcataaatgaatttaaaagaaacatatcagtctggaagaaaatattcataatatctgtaagaaaaaagatgctatacacaaaataacatagaattctaagaaaataatataagaaaatgtaaaaaaaagtccaatcgaaaaattgattaaataaacaggaaatatacagtaaaaaaatacaagtggataataaaaataaaaaggatgattgatttcactagaaatcaattcattgcaaattactataaggagatattttacagaatgaaattggtaaaattcaaggagataaataacatgtggctttgttgtgaataaggaaagggtcattctcaggtaccctagcggagagtgaaagttaggaagctcagtgtagaccaattgggtagccttcactacattttaatgagtatttctaagaatcttttccttagaaattcttgtattatgaccaaatgtgtgtagaaggacgatcatggcaatgtgctaatagagagaaactggaaacaacctaaatgcctgtcacaagggggagcatttaaataaattatgatgtatctttttatgtagcccataaaaagaatgtggcagatccatatagacatgaataggtctatttcatgaaaaagttaaaaaataataagcatattttgccatttaggtaaataaaaaagatcgatatgtatatacacacctctgtatgcataactacacagaaactgtaacattaagatgtagcattaattgctaaccatgctttcctctggggaagggaatgagaagagggtagtcatgagtaggagctactttcacatcttgtacatataacacacttcttaattgtttgaatcttttatcagggagtttactcattttttaattgtgtgaaaagaagtaaagaaaaaaatattgcagatcccaagtcatatgtttaatttattgttaatcaatagaggggcttactctgcgtggcgttaatttgaaaaaccccgagaaagcatcaatgatttgcccattttcccagataaaaagtagtttgttaaggcgaggaccatcaaaacaagaataactaataaaagtagagatatttgattaatggaaacttttatttattcattcttttacttaacaaataattgtagagccgctgttttgtaccaggccatattccagacattagagattaagccatgaactaagcatagttcttgctctcgtggagcttacattctagtggccaggctggaggcggtgggtaggatggggtgggtgtcagacaataaacaaatacacgagtacatatacagtataatgtcacgtggtgtgaagtcccctgataaaaacataggcaagattaggaggctggggtggggaatatttgtgatattccatgtggcagtctgcgacagcctccctggtgataacttccagacagagacatgaaggagatggggacacaagcactttttggaagaagagttcagagggagtgcagcagctgcagaggcctttggagggaaatcttctccatctgctgggaaggcagccaaggaaagggaggggtggcaggagttcacagaaacaagagaaaaagtcatgaaatgtattttgtttatgtgctaagttacataaattacagaaactatttagtagttcaaactccagggagttgataatattatttccatttacaggatgaagaaactgagtctcaaagcagttaattacttgcccaagactacatggctgtactgtgtctgagctgtgtttgaacctaggtctctttgaatttcagaaatatgcacagtagctagactagcaatagtcaaacctatcagcatttcagacactatggagccataattcccaggggaggggcccaataatatgtatttttagaaagctacttaaatgccacagatgactgaccagcaaagtttggggactatttatctagcagtctgtgcacctccattggcaggtgagaagatgaatgtcctcaaaggtcaaatggctcaggagatatacctcactgtggcaaagcatgttctaatcccagattccctaaccctcagctcctctcaatccttgcagtgtggtacagcagggcttctcaagggtgatgatgcacgtgagaatcacgtggaatcttggtaaactacagatgctcttcaggacatctgcaatgggatctgagattctgcatttttagctagttccctaaggacaccaagtgcttctggtgtgaggactacactagagtttcctggaaagcttgttattgctgtccaggcgcccactctaggtttagagatctgagaactcagccctttcatctgaatgtgtgacaatgtccttaatacactattttgtgctcagtgatagaaaatagtgtttcagtgagtatgtgatagtgttgagaaaagagatggtgttgaatggaacaaaatgaagagggaaagacgtgaaatgatgtgcattgctgatgtagtgagatctttcaaagtgaaactggaagattgtatttacagaggagttgggagaagagacttgaggcaattaggcagacaagtcaaatcttccaaagttctggcttcactattggataagtgggtatttttaacttgattaatctggataattggtaagggagaagttctatcacttctgatgtggacagagattgcagcagcaggtgcagagtggtcatggccttgttgggactctggaccctctttcccccaaggtctgggtatttgttcatccttgctacccctgtccctctccatgtctgaccttcaggggcaatttccagatacaaacttgagtgttgccttctagcaaaacctaattatccaggcacggttaccagccaccctctttctgtagaatttcactttactgccatgaatttcatgtttatctaagagatggatcagggaattaagaaatattgtcttcatcattggatgaccattcttccccccttctagagaggttatgcaatgtaattgagcttgcatttctgtatgtcttatggcagaggaacctgctctaagagccttaccaaggagactctagccaggaagcaaacaccactgcattattcagatattataaatcatcatctcttttccaatgccactcgcttccagctcagaatgaccaatgaacagagttcatgtcaatgttgctggacacccagctttcctgtgatctcctgtgtggggctcaaatcctcagagaggctgaagttttcaatttcacaggttgttggtacagggaagcccaccaggcagcctcaggaaaggtggtgtggaaatggcacacatcctgagagatatggtaggaaagaaacaaagtgttttttcttctcttacacagtcaacacagaacactgaatacttcacctctgatcaccaaaaagtgtgtgtgtggcgggggcggtgcggtggggggattcttcccaccagcaagtaattctccagtggacactagttgcacgtactgctacttattctattctattctctacctgaagatagtgttggatcccacagatttagtgctcagactcacaagactggcccccatttcaaaaaattgcaagtagtacattgtcacctatatttattccagaacagcttgatatggtttagttctatgttcccacccaaatgtcaccttgaattgtagtttccataattcctaagtgtcatgggagggacccagtgaagggtaatttaatcatgggcgtggttaccctcatgctgttctcgtgatagtgagtgaattctcaggagatctgatgattttataaggggcttttcccctttcgcttggcacttctccttcctgccatcatgtgaagaaggacatgtttccttccctttctgccatgattgtaaatttcttgaggcctccccagccctgcagaactgtgagtcaattaaacctctttcttttataaattatccagtctcgagtatgtctttattagcagtatgagaatggactaaaacacagctataaggccaagttcttgctacttgctcccagggtctaattaatttgcagatcagctcacagaaatcagagaaacaccatttttttgtttacccatgtattacaaagagaattaccaaggatccagataaaccgtcagattgaagagatgtatagcgtcaggtatggggaaggagcatggagcttgcttgacctttctggatgcaccaccatttagaacctccatgtgttcccctttccagaacctgctcgaacccagtccttttgcaatttcatagaggcttcatatcctaggcatgattaattacataattggccattggtggtcaactcagcctgcagcccctctttcctccatatgcttggttgcttttctggtgaccagctgccagcctgagctatctaggagccctcagtccccagtcatggcattagcatacaaaggacactcttacagctgcagagattctaagggttttatgagctgtttgtcaggagaggggaggaagaccaaataccaaatacttatttcactttttcagaacctgactcatgctctgttctccttgggttcactcagtatcctcaggtacatcattaacctcactcagccctactgcccatctataaagtggaacaagtcattctaccaaatttcatgggatagcatttaattcatgaaatgctttgtttatccatcatatgaaatgagctagtccacacaagtaaatatctaaataaaactccaaagcaatttttaaaatttcaattattgctccagagctctttctaaggaatgcttcctaagagaacactttcccttctttggcttgttaaacgtagtatatgtgatattttgtaaacttattttaatgactcaaggtcgtctttgtgaactgtgtttattgtgcagtgctgaagtttggcgattctctctggagctgttgaagtgcatgattatttgcttctgcaaaagatagccccaagtcgctatgcttttgaatactttctatatttttttcttattcttctttgccatcaagataccaagcatcaatttttgctgctgagatatcatttatctttagtcaccatacatcttcctcctgccctgttgacttcagtccctttaagtttctactttggcaatggttctcaaagtaagattcattgacccctgaggatactcaagaccctttcagagggtttgtgaggttgaaactcttattgctgtgaggtcaaagctgttttcaaggtaatactaagacattgttagcctttcccaatttgtcctgttagtacaaaagcaatggaggtttcacatggtggagccttggcactaatcaatgtagcatcattggctttgctagcagtcattgcattcctcactgccacaaactcacagtaaaaaaaaaaaaagtcactttaacttaagaatattcttgttgagccagcataaattaatttgattacatctcaaccctggaacgcatgagttttcagcattctgtgagatgaaatagcagtatgcccaaagcacaaagtacaatgttttcccaaggaaaaatcacctgttagactgtttggttgccagctcaagtagccatcccacccccacaacagcactgtatttgaaaaaacaactgacatataactcaacattattcacacttgagtatctagcagatcttttcttgaaaatgaataatgtgggcctgtcacttggacgaaaaccactgacagcatttgttgctaaaaatggaatttgagcttttgagctaaaattagaactttggaaaacttgtatttgctttcatgagcttgacaggttcccagtgcctaaagacatttctgatgagattggtggcaatattaacagatgtgattttttttttaactttcgtataacgaagtatgtcaacatttggaagatatgcatatcgcagtgaataaagatcctctacataaccaatatgtaatgttccaaaatgatatgtggagcaaaaaaggaatctatattaggcaaggttctccagagaaacagaaccagtaggatctctctctctctctctctttctctctctctatctatatatatatgtatatgtgtgtatatatatatatatattctctatatagatatatattatcctatatatatgtagatatatatataggaagtagatatgtatgtatgtatgtatgtatgtatgtatgtatgtatgtgtgaagagagagagagagagagaaaggaattggctcatgtgatgattacggaggctgagaagtcccaagacctgccttctccaagcacaagacccaggggagcagatggtgtagttccagttggagtccaaaggcctgagtaccagcagaaccaacagtggaagttctagtccaaggctgacagcctgaaggcctgaggccaggagggtcagtggtataagtgtgagctagagggcaggagcgggttcctgttccagcctgagcaggcaggcagaaagagcaaactctccctctgcctttctgttctgttcaggccctcagtgaattgtatgatgcctgcccacattgggaaggatggcccaatgaattttaatggaacagagtacaaaacattcattgacatggtctcagattctgaaattaagctttaagaaactaccatttgttgagttttggtgtacacaaaagaataatacacacaattgtctgaaagggctattaaatgctttatttcctaactccctcactttatgagggaggctacattttcttcacatatgtcaaccagaacaatctattgaatagactgagtgtggaagcagatgtggggatctacctgtctctattatggcagacattggcattatttaccaaaatgtcaaaactgtctttactgatctttatgttggaaaatatttatttttcatcgtaataggtacttacgttaaaatgtaatgggtttatcagtgttttttaaaaaaagaatcattatttttaaaaaaattattcaaatttctaacatggcaaatgttgataagcataatactacaaagcaagttgttagaagtcctcaataattgtttaagaatgtcatggggtcctgaggaaaaaagtttgacaattgctgttcttattagttcttattccttttatattattgtctcatcaaaacctcacagcaatcatgcaagacaggctgaaaaggaatcaccggtctttatcttgctgctgtgcataattaaactgcaagtctagaatccacactttttagctcctagtcaggggtgtgttcactgtggttggccagaggaagtgggtagaatataaccagatttatgcaacttatcttctatgcatgttagttgggtccgagtggggttctgaggtatccttttatgaatcgtcatgctctttgatgcatggattgtgtagtgtccatcttttgctgcttaaatgcctttgtttctcccaccacccctacatgttcatgtcttacttcctcagcttatgtgttacccaagagaccttctctgtccactcaggatagaatagtctttcccacatatctccccacctcccatcccacttcaacctgcttgatttattttttcctgcatcactgacccattgacaaattccatgttattggtttgttgactggctctcctctctggaatctaagctcttccacggcagacactttgcctgtccttttcactagcgtggacccatgcatagacctgtgcctggcacaaaatagctgatatttgttgaatgaaataattcattcaacaaggcattgagtgagcataacataggaagagacagcccattgcctcagttccccagagggctcagcagaccgtacaccaggcagctggggcaggagtgctttagccctgaattgggaatctgggtggcaggccatggacagcaccagagaaagggaaacaaaggttcagggcaagtggttggcacatagtgatcactcagcactttttagtggatggaggtcttattgctttggcatgtcttcacagtccttattaaggtttgctgttatattggtatttgtttggttatctctttaccacctgcctcctccatagaaggcaggaatcccatagcattcactgacggagcatccataatcagtgcctcaaacaagttgacactcaataaatatttgttaaagcatgaatctctttatcatgaattctatgtgtttgtaaatgtatcagtgtaggtttggtctttctgaacaactctattgtaagcgtcttaagagcagagtagatgtctcaccacttgtgttattggtcttattacctatcggaagcagccatgccctacgactgtgttcaaggccactcatgcatggccctgctcaattcgtcagcctcatggagcctcttgtgttttcagagcatttgactccctctatctctgtgcttcgtgacacggtacctctgctgcctggaatgccctttcaaaatgtgttgattatgctaattcatcctcattctctgggtctcagctcgggtctcagctcctcccagaaaccacccacagcagtctggttctgtggcctcctgtcttccccttgcctctgcggcatccctccccccatgcatgagccacattctattgtcatcatcttcatcacatcaagactgccagatccctgaagggagtgattgcctgacacagctgtattccttctgcctaatgcaggcattgacagattaatgagcatgattaataagctttcgtttaatcagggaattgtaaaaatagagtattacagaaaagtatggtttaaatctttaaggaatttcaattggactatgttgaacaatactcaatagacaataataacacacatttatttgataacttcctctgacaagtccaatgcactttacgtgttcactactgctctttctcccacacctgatgccttaggtgaatgccattgattcttcatggaagagagttgggtacccaccctcaccaccctctacatgaaacacaggtagaatcatttatcatttgtggattatgggctaatgtggaaggcaagaagtcttttcagctattttctattgctgctgacaacagtgcacttggaaatgagcaagacagatcacgagggtatttgactagatatatggaatttcttctcattaaaatccctgaactctaaaaaaattaactaaaactaaatttaaaatttcctgcccggtgtgacctctcctgccttaaaattcctctaacatttattagaattatgagctatttaattctcaaggtcttggacatcttttcttttgttctgacttgttcaatttttcattgttatgtaaagtttcatatgtttatgcactgttttctcaattgcactgtgctctcctgaacaatgggaaactgtttatccttttagctgcagttcataaaatgccaaaggtttcctctgaacctctgtaggtgtctctgtgagggttagagaaagcgaggagagacggtgggagagagacaatatgaacagctgtgagaatgagatagtgagcactagactacaaaaccttgaattcctatacctcccctctaccccaaccccaaaatagcagctcagattttgcaactcgataaaattttaatagaggattttattggcagagagagagaggattccactacttaagtttgacagtcaataaccactaacgcatatcatctgttatgtcatctgatgtctgtgctttctctctaaaatgtaagctgtgtgagggcagagattatagtctatagagtaagttatgccttacatatgaatgaatgaatgaatgaatgaatgaatgaatgaatttgacaaagaaggtttttgacagacaacggtagtctctatcaatatgtaatggcttaggatatttaaacacaagagaactgcttttgagtctggaatgatttaaatgtacagtgaacatataatgtagtgtctacactgagaccgttttgaaaatgacgggactggcatccatattacagaagatgaacaaatgtaaacaaagactatctccagcaagggagatagcatgctcctaagtggcatctcaaagggatctcactcgagggcggatttgaagatttaacctttgcccacgggaacctcaagtcctatttgtttctgccctattagaagtggttattacttgcagggaaccatccagtcccacagggacactgctatgggaaggaggtgaccttttgagttaagggaatctcaccggtagcatgtaagccatctcaggtcactgcacactccaggcttctctcaggctaagcagccagttggcatctctgaggcgcccaccagatgggtgtacaatacactgtgtgatcatttgcaaagtaaaggaaggctgtggttctgtgcttaatttacagagtgtacaattaaacagaaatgagatgcgcaaactctgtgaaactttttgcaatgctggtatgaggagcatgggatttagataagatcgtttaagaatgtagctgttatgttttaggagacagggttcgacctgtaatatatccaggtttatgtgatacattctattataatggtcttatactctgttcatgaaattacaaatgtctcacaggaaaaggttagtcagatgttatactggcaatgcccctgacatgtttattcagtccagggtcagagcatgattattaaaccctactgaaaaaaataaattgacattttagactgaaaatcacatcccttctagggggtgtgcatactggctgtgtgcagatattatatgtccctgcagttatgaagcaatttatgtgctggtgtggatttccaacaagtcagttcatcctgtttcccatagagtaggctagattggatctgaaggcagcccttctctcctctctgtaatgggcaaaatttaataggttacagaaagccacaaaccctattcaacatggctgctgccatgttcccgaaggccctgggtgctggcttctcccatcatctgtcctctgtcctcagctgggagccctctgcgaggctgtcgcagtgagcagtgtgtggaagaggcagtggagcatctccgcagtagaggggctgttaccgcaggatagtgagggcctggtgcctcctgatgagatattagcccactgaagcctgacctcggaagagtgggctctggctcactgagcatcggtcctcacccttccaaatcaggcttccaccatcacacttttcagattagttatctcccaggaatggatgcaaacactgattttctcagacctcatttcccaggaacaagttatgacctgggagaagctgggtctgtaaaactagcaacgaaagctaaaggtgaccctctcatcctttgaagtctaaaattatagaccatacaaatgagaccaattaagaaacaatgtgctttgcaggatttgatgcaatagatacatgttgaatgatgtctatttgccagtcctggtttcttaaccttcccccgcaaaaacctagcatgtgttgtgcacatagtaggcatcttcccttgctaatcatatagaagtgacaaactatgttgagaaggcaaaacatgaaaatagcagttgccacatgactgcaatttccttcagttcacttagaagggcagaattgtcttctgcaaccagaatccacttagccaagagtcatcagcaatgttcctcagaaaagtagtaccagtaaggaaataacctgcagtgtgaattccagaatgtctcttcctcctcaccctgtccatgctgtgtccctaccctctgtgccatcccagttctgcctgctgaagtgagaacatttcaaggcttctttgagcactgcctgtagccagagctatgtttctttgtaccagccccacgcccaaccagctaaatagtatctgctctgtcctcgaaaccctgccgaggggcttaatcaccatgcattttttgggttatttcttgctaagcttatatttagttatgagtaatcagtcttaccctcagcactagacaattagatgacataagactggcactgcattttgttgctgaatggactcactcgttctttgtatttttctgcggtccttttgtggggcccgatcatgtgttaggaattacacccggccctggggatgcccctgggaatgaaatggatggtctttgtagtcaccgagcttccttctctctagtgggagatgtcagcgattcaatacgcatttacattttggtgcaggtttctcagctttggtgctagtgatatttggggtcagataattatttgtcaagggagactgtcctgtgcaatgtagtacagctttcctaacctcagccataaagaccaaaactgtctctagacactgccaaatgtatcctgtggacaaaattaccaggttgagaattactgctctaacatgacaaatgcgaagataaatgtacgttctacaggaacccagatgaggggcatctaacaaagaccctaaagtcaaggaagtcataacagtcaagagcccagtgggaaatagatggcatcttcaactttgagcaactctaggcagcctgaataagacaatcccttacaagatgtgggcatggtgcagggagactatacagaggagacttataagcaaggtcagatatgtccaggggaaaggaggaggggtggtatatgaatgacacctattatttctatgtttgaaatctcacttataagaatgtttgtgttcatggttgatttgttggggctgcccgtctggctggtgagaaattcaatctgagtcatattttgggagactgtctttcctcactggagtatacagaatgctgagaaagggtctttagttattagtccttagtggtaggcttattgtgtaagagttcaaaaatgtttgttgagtgaaggaacaaaggaagtgagggaggacatgaaaaaaggaggtgaagaaggaaggaaggcaagaaggaaggaaagtaggaaggcaggcaggaaggaaggaaagtaggaaggcaggcaggaaggaaggaaaaaaggaaggcaggcaggcaggcaggctgaaagaaggaaggaaggaaggaaggaaggaagtgaggaagggagggagggagggcaggctggtggatcacagcttttagatccagcttcatcgtcacccagtgtgaggtgctgtcgctgactggaggtctgccttggagatcgtgggaaatgacaggtagtctgccactggtggggactccttcacaaacccaagctttggacctttcatcctcccccagcttggtgcccacccacctccgtgagcctagactctgtttgcttgtttctgtgaaacaaaagcttgaatagtaataatcttctgggtgcctagcaactgctttagaccccatgacacaaaagtcattaacaactctgaggcaagaagctaagaattgaggatttgcagggcctgccacatttttggggatggggcagggaaaatgtttctcattccttccattcttctacagctttgagaacagaacacaaatcagttatccaatagcctagcctgtcctgtgacaatggaggagcgtgacattgaacccagggagggagcaaagcggtttaggggaattgaaacctactctgtaccgcacagaaatccagtgagggcagagtttgaaaaactggtaatacagaggaagagagaaaacggggcacaaaaaacctagaaagttactgcgttgataacagtttttactgagacccataaggaactgcagcacattgatggaacacacacaaaaaaagtcttttgtttgtgcttttgttctccaccaatctacatgaggttctgatgggatggatggcccacaccttccacccagtaggaggcactcagacttttagggccctagatggaggccccacagcaggggcagcaacagagccgcacccctcacctagagctgtgcagagtcctggcatcccctcagtgctcctaaacaggaatggaatcgccagtcaagaaggtgctattttttatttttacctgttcatgtgttgactttttgggactgaaaaccccagagctgggtattttcttcaacacagaagccagaccagctgcataaaggactgatcccaggccttctagagtgttctgtgcctctgtggtctcaggaattcacctgctgtgtcctcccgtctgcgcccccacccccgccccagccctatacccttcctgcttccctcaccatctcgtcagtgtccttgctaattcgacaaagttaatacccgattaataactcctatgatagaagagttcctggatgagctgtagcccccatttacaatctgctggtgatagaaaaattatgttcagctcagtaataattgatggaaatggtctcttctcttctgcagctgatttgctttgtaattgagatttaataatgtaaatatcacttgttttcttctcaagatgaattgccttctgatttgctaagctcaagcctctttagggctttcttattgctttgtctcttctcatgagattctaggtgagatttattccttatttagctgtgtttctctttatacacacatacacacacccatgcacacacacacacattgagtcaatggttggaaggaacacatgttacttttcaaacagctactgactatcgaaaattagagctaacgctttttagaaatcatcaaaccccaccccattattttaactaatgacagaacaagaagcctagggtggttacgcaatttatccaaatggacacagaaagtcataatcactcctgagcctagtgtggtgttacttcctcaatggtgaggaaggtttgaaaagaatcaccctgcatcttactttctttactgccatgcatttataacacttgtgtgtctgtctgtgtatgtgcagaaagcaataaatatcacactgttttttacattaatttcgtgacttactctcaggatacgatattctataattgaaaaaaaaaaaccctctagagtccagtggaagtagagtaagctcactgcattggaacggtggctgcctctccatcatgactcattttctgcaggaggcccctctacgggcagccctaaaaatctgcagacaccaccgtcgaggcaccaggctccagcacccgccccatatggtttcctgtgcagcagcctcttccaaactacctgtttctatccacgatcctgcagtccaggcctgctctgttggagccctagtcaccttgcgttcctctttgtctttctccctcacagcgacattttctgccaagaagatggaggctccatgcttcctaaggcaacaaaaacaaaactgataaactaatttgggctggtgggaaacaatctaggaataggtcagatgcgtttatttgatcaaggcctggagtgtagtgatgaggaagcacatgaagacccagcaaggaaggcaggggtctgtctcccctggggcctgggcagggtgctttggaggacgaccagccctggctgcagccaccatgtcacatcacagcatgctcaaggctccatctcccagaaccagagccagcgcaggtttctggggcagaaacagaactcacacctccaaacttcacttcctagaagctccgagcccaaatcaaatgtcgagtgctgtccaaggattgggggagagtgcacagaatctctatcttctggtccagaaagaccctcatgaaaagagccaggaaagagcagtggctgagcgacctaagaaatgagctggccggatcccctcgttttgcagataaagaaaccgaggctggatgaagtaaagtggcctgctcaggggtcctggctagttagtggcagagcaaaggccgaaaccttggcctcctcagcttccatttggcacctctgaacctgttggtgctgagctgccgtagtcacagtccggttataacagttgatgtaaagctgaaagtttgggcatcatactggaattgtcttcactgtcctggcagcccctttcctggttgctctgtatctggttgggaaggattagcgaagtgagccatgtaactaagaagggatatttttagtaaaggcgaggaggacagaaagtaggtagaagcatcattttcctgcatttgaagtgtaccctcagacgcatgaaaatgggcctcaaatcatctaagtggatgattagttatacctatgagacattattccagtctacccatcaaggagagggaggaaagaacagctacttgtcaagatctacatgaatagaatcttagaaaggaaaggaaagaattaatttcccccattaacacaagacattacgttcagacacacatagtccttcataattgtcaaaacctctctttcctccccatcaccaagcagctaaagcacagtgacagatgagagctaccttgaaattgtcatggtgtctctatttttgtgtgtggactgtcaagacctcaaataaagccagtgtggcctgggccagctctgcagggaccttatgctcctttgtgggacagtgaccctgagctcctgggttggaactcagtccatcaatgccatgattatcagatttccagaacttaaggaattatttgggttccttagtcatagaccatattgctaggtgatgaaaggttataaaacattaaaatggatagtgaccttggaggtcatctgatgcaatttttgtattgacagaaaaaataattgtggtttgaagggctgaaaacacttactgaaaaatcacatatttgtgacaaaactgggattagatcctcggtcttctgatctcaaattcagtggtttcctccttgagttctactgttagcatgagtcacagaaggtcatataaagtgacttcttgggtgactaggctaagaagggaggctagcaagacagatgcctttggtgagaagtcagcttatcatagtctgaggtagatggtaagagggagacagacttgcctagaatagcacaaggtgcagatgaggagagcccttgccagctaagttttcaaagggacccctgcccctagtggagacttcgccccttgagtgcacagctcctgatcctttcctctcagtgcacactagggctcagtgcatgagcaatgctatctcctcgtgatacttcagagctcagacctttatgctctgcgaagtgtgcaggatgtctctggttgtggcttgcatgccaattgtgctgcctgggttagtgggtactttgcctacaagctaatacaagtattttgaaaatattgatgaatgctgatggttggcatcattgttaaacggctgtgatgccaggaactaatatagggaaaggataaaagagacagcatcaaataaaaggaaagaaagagaggaagtaagaagagtcaggctgcatcaaggcttcatctgcaggaactgagctgtgctgttcctcaaaagggcatttccccaataccctgaaaagaccctaggactatttctttcagtgctctgggccatcccaaccacttcagaaaggggcaggtctggtacttggtctgccaggactttgagccaagagcccttgagcccttgctggctttccttctcctgggggctgcagtgctgattccctctctggttggcttaggctccaaccagctgcaattgtctgtcttccagagaagagtatagctgatgagcctggagctctgggagaaagagagcacacagaatctttcttgaccatcagtccagcagagtcctacattggagcggccacaccctatttggtcctaagccactgcctctcttaagaaggttgagtgttgggcctgccccaggcacagagtaagatgtcaccagtagctaaggccctagggcctgacagcagacctttcagtaggctaggagtatgtcggccacctggtttatgatccagaccagtgtactttaaagaatgaaaggtgacagttaaaaagtacactgtcgaccgggtatggtggctcacgcctgtaattctgtcactttgggaggccaaggcaggtggattgactgagctcaggagttcgagaccagcctgggcaacatggtgaaaccctgtctctactaaaaaatacaaaaaaaaaaaaaaaattaactgggcatggtgcatgcacctgtagtcccaggtattcaggaggctgaggcaggagaattgcttgaacccaggatgtggaggttgcagtgagccaagattgcgccactgcactcctgtctgggcaagagagcgtgaaactctgtctcaaaagaaaacaaagtacattgggaagacaggtgtcaactggcactatcccaggaaaacctaactatgggtccacccagctcaggaaaacaacaaaggcattcctgacactgctatacgaataaattaatcctcagggaaaacaagtcagacgcagttggcattagaaggaaagttttaattcccccaaaggcaagcaaagggcaaaggacttactttgatgttgtaactaattgaaggttttgtatactgcccatctgctggcagatgccagccctgtaggtctgctttgggctcaagaagccactttgccaaagcgcccttaggtaacacagtattggcagtccactgaccacgccagggcacaagacactcctatactacaaaaatacagccttcttgaagaaactgggcctgggtgactggctgtgcttgagtaggttgctgcagacaaggttaaggcaactttctttagacattgtaaatgaaagaggcagtgtctccttccatgcattgatcaggtttctaaaaaaaatgctgtcgtttaattatgaaggtttttttttaaagcagtacttttacttctcagaactcatttcactttagcttgttgatactaaagtaaccctgttggtttagaatccaaataatcataatcataaggggaaaatgtgtaaaataaataaaaacttttcaagtgtacttaaacattttgtcaataacttagctgtttaagctctactatgtaaaaataatgatttttctccttctacccctgcattctttgggtctgaactgttagtttcagtttattttttatactttttagaataaaaatgctagcgactttttttggcccaaataggctactctgctcatcaaatggatttaagcttctatcctcagtcatttgtctgcctgtatggaattctagtgttttgcatcctcattctctctctctcttcctccctccctccctccctcctctgcctctctgtctagctcctctcttccttttctggcacacatactgcactttcatttaaagggaatgtgccacatcctcacaggtaccctggctgtttctgtgacactcactcagaaccactcccaatgagtcaacagtatcatccagatcctaaaaatgttgtgtcttgattcttcccacacataatgaacccatctcaaaaaaaaaaaaaaaaaaaaaaaaaaagacacaagcagagccaagctaaacacacctcttcactgtgctttggaaagaagcctcttgtcttcatgctcttcgtttgactatctggggatctctagctgctggagactgacctggctatcaccaccctaccccaccacaagatttctttttcctgacccacctacaataaagctgctgctgttgacatcatgatggtatatttttcatagaagctgacagttgacaggagatctgagcacactgtaagatgtgcacatcctcatacactccttggctctgaatgacttctcagcagaggaagcctgggagcatacatgtgtaactggaacttggaaaatgaaagcaacaggagtcctcaacttaccaaccctgaattctcacccctgactgtacattagagtcccctgggaagttttagaggatgctggtgctgggacccctcaccccagaccatgttcaccatccataagcatgaacacaagagtctatttttaaagtgctccttgggtaagtctcatgaccccccagggatgagaacatctattttaggtgtatcctcttaaacctgatttcagagagtttccttgccatcccttcttctgcctccacctacaagacaaaaccctttaggtcctctcctctttaacttttcccggtaaagagttcaagagccccagtgtatgagagtttctctttggggacagttgtactggaggagtcacttgagtccttttgtctttgtgtcatcctcggctactcccggtctgacagtgaggggcattaaacacttccatcattctcacacatgcatggaagggaggatctagaaaactcacccctgccagggaattcctctgagcccccagctatggagatctttattaatgtactccttcccccactggaagcacagttaactttcacagtaacacattgatcttgtgattagccaacttactgtcagcctcagggaaggcagccagcatggccgccctggatgggggcaagccactcctcccgcagaggaggtcctggtggccacagcctgagaaaggtttctgagcccaaaacaaagagcttctgtcaccgccagcaagtgagacattgaccaggcgcttggcctccaaaccaaaatgactttagcacaattcaattgcttgtgttaattaaaggaaaatgaaacagtgggtttatcacacttttcattaactccaatgcagcaaaggtaacaaatctggaagttgggagcaggcaaggatgcaatgtactgctgtccacattccttggtttaattaaggagggcgggctcagagttgcttgttgccagtagggttctaaggagagtcaaggattggaggttggggcgggggacggagttggggacagaaaatgtggggcagagcctggcagaaagagagtggattaaataggagagggagagggggagttctgcagggattaagttttcaaacctagccatcaggcataatgtgaacacatactgtgggcttagcctacgttagctgctgtaatgagttaaggaagtagaagatgtgacatctactcagggtgcttgcaacttggacaatggactaggaagaagggtaaacagtacaagactcaggttatatgagccatactgggtcccaaatgctaaaactctaccgtaattccaaattcatgcatgtttctgatgtgtatccttcaaaagaagggggctctcacatcaggaggtatgtgatggagaaggatgccaggagatctctaggataaaaggagaagtcctattcataaccctcacaggtttctagagggcagctttcctccaccctgtccactctttgcctcccccatgggaggcgggtgaccaacgtcatggtgaagtggttgcttgggcatttattgggcctagttaagaagacataaggctgccatctagaagtgaaggcattactcctgtgtctccatcccctccctggcctgatacctgggtctggcgtcctccttaccccagactctgcattgcgacacagctcatactctcgggtccactttgagcctgtgactgagtactaaagtcaagcattctactgtgcaagtcccactgtctctaattctcagagagaaaggcaagaacctcatgtcagccttggatcccaagtggggattgtagcccagcggatgttttgatctgctcatagctcagttttgtgattatgttctattagccaaaatcctggagggaaagaaagatgagtgataggattcaggcacatgtctcctcaggaacttttgacagtctgtacctttccctgcacatatcaaggacaagaagcagtggggaggaggtggtttcagacagccttatctccttcctgtggtctatcttactccagatgtccatgacaggatgtccagcagatatttacaaacatggttcttcccttacagaagtaaaatctgtgttccttgacagcttgaattgtgacctagcttttgagagtgggtaaaaggcttgtttctaagatggttcaggcagcctagttgtggccttacaggccagaggcatgcacttggtcgtcaatcacctggacatttgattccaactttgcaaattcagtgttgatcaggatcgtctgtaatagtctctcttgctgggcagcagggaaactccttttcttgttttcccagaaacccaaccatgtgagccaaaaagacccctgggtggccaccctctgcccactcccactggcttccttctggcagctcatttccctcttgctttcttgctcctcccacttccccttccccacaccttgtcctccctgtgtggctgcctcctgaaaccctagatcctcctcactgctctcatctcctgttgttcttttccttggtggcacaagcccccagaaatgttgctctctgtgttacctcctggctggtctggtacatgctgcagcagttgctggcattttatctcagcgcagcttctgcaggtagagccatgccctagacagcaaacctagaaggacagtcagggtggagatgcttagaggtgacttttaatcattccaaatggagaaaccagatggggattgcctcaacaccaagttttttttgttttgttttgtttttgcatactgtgaatagaccaacaaagggacaggtcacctgtttagcctgttcttacgctgctaataaagacacacccgagactggggaatttataaagcaaagaggtttaatcgactcacagttccacatggctggggaagcctcacagtcatagtggaagagcaagggacatcttacatggcagcaggcaagaagcttgtgcaggggaactcccatttataaacccatcagatctcataagacttcttcactaccaagactacagtatgggggaactgcgcccatgattcaatcatttccacctggccctgcccttgacacgtggggataattacaattcaaggtgagatttgggtggggacactgccaaaccctatcttcacctcctaaaattgtccccagaggtattcagagagaagataagatattttgtcaggactttgtataatccaaaaaagtggaaggctaaaatctttgacccctcatggttcttttaactttataactctaaggaattggctgaggcaataaacaggaaaattggatgcaagattgatggctgagatatcgctggcacaaaaggacataaagggagaaagaaaagagaagtcggtcaggaagcccccatattttgctctggatttcctgtttgatctttttcatccccaaatagttaggtttctctcagctctaataaatctgtttgactcactacaccttacttgaggcatctagaaatgacaaagaactaaaaaattgagcctaagatacagaaaaatataaactgctttgagtcctggccccatgagattgcagactatgcaaggtgaagatccttgttttccatattgtctctgcccccattccctcaccacagcgtctgacacaacacctcgctcatcctggatgtgagcagaataagtgcagtgaggtcagagccagcaggccagccagtggtccttctcccctgagttgtttttctgtctgttcctccatttctagcagaacagaccctgcttgtggatgtttcatgctctttgtattctgtgactgtgctgttggaatgtgtgtccctactgaaaaagcccccttagatccacagaaccctgaggcttctgctcatcctatccccaaggatgcaacctgcatctgaggcaacaacccccacatccccggatgaatggcctcatttgtatttttgcagatcttaattttgctaatgcagtgaattgaactcatcttctttgaggcactctttccatggaaacagcctcagtttttacatatttcttccagtgattcagaatctgctttctgttgcttccaaccttgttatattgggatgctggagtgcttagagcaggttcataatgcctctgggttattgtcttactacaggacattttgctataaagcaaaactgttgagcagacttgcagttcctgtttgacaaggaaaatattgcagtcttacagcctttttaaaaaagtccttggtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgcagtcccagctacttgggaggctgaggcaggagaatggcgtgaacccgggaggcggagcttgcagtgagccgagatcccgccactgcactccagcctgggcgacagagcgaaactccgtctcaaaaaaaaaaaaaaaaaaaacaaaaaagtccttggtgaacacatcttcagaatctttccaatggctcacaggccatcttgcttaccccacctctgtctttctttccttcctcctccctctccttcctatcctatcctgttcctccctcatctgtttctccctgcccgttttccttcctttaactcatagtcagcaatttggtttcctggcagctagtaaagaggattaaaacattgattgccttctgccccattatctgcagcatggaatcagaactttacattgcaaccagaactggagagggcagccctacagcttcctaggtctccaggcaagtagcaacctagattcattctgctttaaaaatttcacccagcattcaaagtagttaagaaaataacaggtaagtcaccttcactgagtctgagatggagagaagtttcaacaacattttccctttttcaacgaagaaacatgttttggtgaggatgcatgttatgtgggaagatcatgaagaatccatgcatcctgattctcagcctcagtgtagccagcctactgagccctaaactccaagaacagtgagtccttggaggggcaggctccacaagggtctcagcctgaggggctcttagtatattttcctaacacactgaccctagaagacttcacgtgtgtgggtgggagagagcccacgaacagcgcggcacagtgcatcacagcttcactgctcagggtgggggccccggcccagccatggaggcagcccctgggcatgtgtcagaaacgtggaatcccagactccactccagacctactggatcagaatctatatttaaaaaaaaaaaaaactctaaagaatttatatgcaaattaaaatctgagaagcacattgtacaaacttgacaaaactcattttctcacttaatgaggtagtattataacgatccccattttacatgaaatgcactttttcttccttccttccttccatttctgctgttgcataactggtcccataaaaacagcatcacagacagtgaaaacaaatcccacattccagaagttgccatgtcatctggtaattccactggaaggatgcaggacctgtcttacccatgtaaatgcacacgggcctccccattctgtgaaaccatcccctccctacgtgtaggtcaacatttctaagtctactggcattcatggatctcattttatctgaagcttttaaggcatctggctgaggtccaccaagcagcatgatctgggtctttcttctctctaaggaaaggggaacgttgaccctgcctgagactctagccaggccctcagcaggtagcccatgtgtttggttaaatgcaatgcaatttaattactcatggcaaaatcctctgtggtacattttgaaaaaataatggagtcatcgtagtagaaatccaggcttctcattctaccacatttatttctttcaggaaaaaaaaaaaaaatggcgaggtgtctggaacgtcattttgatgtgtttgattccattgttgtttaatccttaaaaaggcttagattgatcaactaatttttctttgttaaatttcatttaaaaagtaatctcagaatccctttcactatgatattctgttagcctatagagaaataaagggagtagggcaagaaagtgtttgcataaccgtaatgcaccttgaagagttagtgtatgaactagcctggatcattatgtctgctgtggtagaggcttttgatccagtagcaccatccagcaaatgccggcttaacccagacccaggtggcgcatgctctggagtttctttcttgaaattgtctaagttcccatctggtggctggaaccatcgggggtgagcagcatcattcaggagagacgctcagatcctaggctgggagcatgtgggtcactatttcagaccccatttcttcagtctggggatctttcaccctgcacccttcagccacttcttatgtgggtccacccagatttcccaatgactctgaacctcacatctatgggtacattttgggaccctgtcaccaggaccaggtttgaggagggtagccaggcaaatggattgctcccactagccaatgcattatttcctccatggaattgcacagattggactaacagaacggtgctgatttgcagtgacatttctataaatagatgattggtagccagtatccagagactgatggtactccctgggtgggcatgacctggggtaggacatggaggcagggaagacaacaagagccagaaagcacatggtctggggaaatgggtaggtgggtggtggaagcccccaaggcttagacttggagcagagtcagggcacctaagtacctgcctccttaccccctatacccaagcccacctccacagacccttactgctgcacaccttacacactacacactagcccacctcctccaccttcctgctgcacaccctacaccctgcacactggcccacctccacagacacctttctgctgcacaccctataccctggacaccagcccatctccacagacacattcctgctgcacaccctacaccctacacactgtccccaccttccaccttcctgctgcccaccctatacacttgcacaccatcccacctccacagacacgttcctgctccacatcctatgtcctacacactggcccaccccctccacagacaccttcctgcttcacatccatggtggacccaaacccattggattagaacatgcttgcacaaggttgtggcgaaagctcacacttttgttgccctgaaaactactgtggccctcaggactgcaggcctataagaaatgcaaatggctgtgccttatccttgggctttatcttggttttgatgggatctcagtgttttgacagaactcagaacatttgtgatggaagacagagggtctgttgtctttgcactgaaccacagggagtaagataaggggtaaggcggagaggccagattgttgcaagaacctgtaatggtggcataaaagcaatacaaattttgcagcccataatattttgaattataaatgacaagtttcacaagtacctgagaatgaatcctccagggagctccaccaaattgagtattaaatccactaggctattctggcaaccacagatccagcatttggggctatcacatttgtgttggccaatgcttattgagcatctattacaaagccatcgtggggtccttcctcgttcattcattctcactctatcttctccaacacaggtggaaacaaaaccaactactttgcatctatttatattaaagggtagaatgcttacttattcgttctacaagtagtagtttgtattctgcatacaaaaacatttctacaaatgaaaaattaagatgtgctccacagtaacataccctaaagttattccatagttttattatattattgatcatgacagttctttttaaaatatcagtttggcaatgcactgaagtatttatcatgtcatctctgagttaattatcacaataatcatataagaaaaataatgacatgttcttaccaaatgctctaagaaagttaagtgacttgactgaaaatacattgatgcaagactcaagcacagaatttctttcttcctttgccgtatcttttgagcaacatgatgccctatgtctttgacttgatgtcctactccattctgatggctttttctcttcctcctcctacaatctctagatgtgaatatggttctgtccctggttacacagtttcctgattgtttcctgtctgcttctttcttcccagaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactgtgagtggacctgcagccagggggttctggggaaaagacggcacagggagtaggtggacaatctggtaatggcagtgccattttccaaaggacccaggttcctgccaacaggaaaatacttcatcagatggctttgcccaccatggcctccgtgccatttgtccctggaatcttcctgtgactgccagagttttcagcaaatggagagaattgttaactgagaatgggtttggaggcctgaaaaagaggttggggtcaatgcagtatcttcaagcagcttatttttcctgaaataaatgattattttactgggaaagagggttgtcacaagaaatccatttacatagcaaatggctggatgtgcccttcatctctttcacgaaatcactctgtgtgtgcgtgcgtgcatgcctgtgcatgtgtgtgtgtgtgtttcccacagatcctccctatatctcaaaagccaagaacactggtgtttcagtcggtcagaagggcatcctgagctgtgaagcctctgcagtccccatggctgaattccagtggttcaaggaagaaaccaggtaccttttaaatgacacctggacagttctgaagcagagctgatggtctatccccacatgggagaaggatgaggatgaagaaaaggggaaagataaggcaaaacagaaatatactatgccctcttttgtaacaaagtctatttttacaacgagaaaaaaaatggaggaggctgggaagtggagaaaatgaactgaccatgattctgaatctgagactggttgtagacatgtcagtcgttgggaattagaagccagtacatttatcccattgggcaagagcatcatttcccttctcctcctgttggacactgaagtgcttagggtttgagtttgaaggacgagattagttggagaaaagagtttggtgaggaggagggcctctttgtagaatgaattgatagcaatgtcttccctcttgcaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatggtgagtgctggaagcctggatgcagtgggctcagccacatggggaagcttgagggactcaggagggaggaagttgcaatctgcttggcctgtgtccatccatcctactcaacccaccacctgtagataagacatacttctccctgccattcccctagcatgccatgcagagatagttacacagtaattgatatttcatggtcattaaaaggcaaagtttgcccttacaatagcagtaaaccaaactgtgaatcaggtagaatggtttttgtataaagaagatagaaccatgggtcaattcaactgtgtaattttaagatgccttctgtagttggagtctctgattctgggggtgatatttgttgctttaaaccaagtcacctgcttccatcatgattctcatgttgcttgcatttcgtattctcatccatggggaagaatggagtagtagtctgagaccttatcaggtggctgctctatccacaactggagcagcaaaccctctctgaagatctttccctcccatatgggtggagaaggcttgggagccaggactgacctcctttaaagcccctatgtctccctaactccattttcccacactgccgcatccatatccttctgcaacatttcacaccatgggccagggccagcttgttgtgatactgtatgtgcatatgtatttgtttatttgctgaggtttgattagagggaagcatccgatgagtaggatgagaggatgaaggatgaagagaggtatccacgtttccacgtgcacctcagacacaagctttcagcactgacattaagtaaactttgtccaccaaccatctgaaatgtgtgatctatgtcttttgttttctctctgcattgtgtgtgcattgtgctgtgtgtgtcttagaaataagcccctcatcagcagtggcaggtgggtacagcatgttccttcctacctctgcctgcctgaatgcctatgcctttgagttttagcctacttcaaagataggcttgcctgcttcacctctgtaatttatgtctctgaggtagatagacctcaaggggcttggtttacacagtttagataataagcatgtagaatatgatggctttcaaatgcactctgtggaatagctttatgtgtttcaggggaaggggtttttgcccccaaaacaagaaccttatatttggtcatctttgaaaagaatgctcattctgctatttctgtacacagcagcaccaagagcaacccagcccagagaccaactggattaatagataactgtctcagtggggacgtcaccctactatgaatgttttattcttttagcccaaggcaaacagggctaatggtttagttctaaaaactttattttaaaataaaagtacttgggatcattattataatcataatatctgctatttaccaaacgtgtactggtttctaggcatcatgtcagggctgtgcaaggcaggttattaaccccattttacaggtaagtgaaaggaggactaaagagcttgggtaacactgaagaccacttagctaatgaatagatactggatgagacctagagatggagccctgtattaggtattggagcatttgcccacagcgtcagcaaagagaaacaggcacacacatgcatgcactcacacacactcttacacagtcgctgaggcatttagaagaagcagtagctgctgctcagctctgcttccagaactggaagaccctcaaccctactgttctaagatgtcaatctcattcacatgcaaagagatgacatttgaattttctagacctgaaatcagctcctcaactatcactgctcacagctcttgatccaagacactcacagatgtatagtgctgcccgcatcccagtgaccaggaacacccatgccttagtcttaaaaacactgagaggatagggtgggattgagtcacttccctgccacaacctgccattatccccatggttggtgggattgctgttgcagggagtatgatgcagagaagggcacaggactgacaacccaatggcccttcttgtctctctctgcccttcactaagaaagaggtgtgtcatggcagataacaacaaccagtgtataccaaaactgtcttagttggcttgtgttgctgtaacaaaatactaccgatgggatagcttaaacaacagacatttattatctcaaagtcctggaggctagaagtccaagatgcaggtttctgccaaggtggttcctgtgagggctcacctcatggcttgcagacagctgctatgtcctcacatggtttctcctctgaattctcatagaaaaagagagagagggagctttctggtgtctcttctgataaggacagtaactatattggatcagggtcccacccttatgacctcacttaaccttaattacttccctataggtgccacctccaaatacagacatactgggggttagagcatcaacatagacattcggtagtagagggatgcgattcagcccatagcacaggcagacatttacatcccaattcagccttcacatcccaattcacttaaacttgctgagtcttccttcccgcatatatgctattgggacattaacgcctgcttcaagagactggtgacaggattaaatcaggttgtgtccattcagaatcccataaatgctacatttagatgtgtggattcgaccacaaacaaaaaccacaggcctgagtccactcggctaagtagggtgatattttctgacctgtggacatgagagtgtcactgtgaattgtcaataagacaatgttcatcaaagcggcatgactcactgaatactgtcgtgtttctactggtacccgccaacacttattgtgacatggcccatgctatcgcctcttccccccatatgcctgccagagtcactgctcaactggacttcttttccttcctccaaagtcccctgtgcccttcctctccagcattcacggtccctataacccaccctatctcacttcaccctgttggcacacacttgcattcagcatcccttcctgaaggaagactttcctgacctctctgagcaggccagtccccaattctgcatccactcattccgcgcctttgactgctgcactcacacagagcattgtctagcattcatttagcaaacatgcatttaggacccgttacaagccaggcactgttctatgtgatcaggagacagcagtgactcaacagatagattccttgtttctatagactttatcttctagttgtaattttgtttttgtttaatatttcaaaagttgtttgtttaaagtatttcttcctctttatcctgtaagctccaggaacataggggctatacctggcttaatccctaggacctaatacaaggttctacacacagtagctcacaggaaaactttgtggaatgaatgaatgtgtgaatatatgtggggatggaaaggacgtattggtcacagccacaatttagctgtcaggaattgaaatgccatggcatagaggaaggggtatgtgtctcaccctatgctgctcgctggctgaatggctttgggaaggtcaatctcagtgggtcttttatatttttaatcagtgaaggcattttggataagatgtttggtttctgtggtccctacaaggcacaattctctgatcctatgactgtgtggcaatagtttcagcacaagatcagacagatagtgtctggttgacctgctctttctcctggccagggatgctcttcctagtcctcaatgcccccataattatgcctaattattaccaaccatttactgtgtacagggtactagactaagtgcttttccttttttatcacccttagtgactctatgaagtaagtactatatttatcctgattttacacttgaggaaattgagaggttaggcagataactcaaaacaccctggcttatcagtgcttgtgctgggatttgaggctatatactcccattcccatgctggagcactttgctcctattgcaatccagctcataagacctggcaacccatcatggacatggtgactttccaaatggagcctcatatcagcaattagtcttcttggacccatctcccacatcaaattctcctttcttctatctacttctgaagccattcttgtaaaggacaatttttagatttgcaacccgtatgctcctacttccccaacacacagtccccatctgcaggcatgcatttgtatttactctcacagacggtcagtctgttttctgagagccctctttgactctgccccgtgatcccttcacagcgtgcctctctcacactacatcttttatatatttcatacctacaagcaaagagcaaaggaaaatgggatataagcaattttgaaagaatgcagagggcaaaaactggagacaatgggttggtgagtggttggaaacctgaaatgactagaaacgtgtgagtgacaacatggtaggtgatcgtccaagatgaaacagctgttggcactgatatgaaatgcttcttctttatcacaccggttgccttccccacacagagccacaaggacagagtggtcagctaggcagagcgccaactcacagccatattttagaccacccactttccttagccccaggcaactgcaggtgctggaaaagtggcccgatgtggaaaggcggtcaacgccagcagcaaggaacacggggttccagtcctgactctgatacagacaaactgtgatgctgtctgttcctaagtcatgcgtaaaacagaaaagcagagcaagatgaactccaaggttactttcagctttctaagtgtctgggctgaatttgggaaacaatgggaacaaaaggcaaggaacaggtctccaaaagctatcaaccataaccatggacaatctttgcacagtagcttgctccaaccattgcaaatcagcttgctctaagcattcgttagctttactgagtgggtgcagccattggaaggtccacagggagccccttggcacctcgaagtcttgccaggcctaagtacagcaggggtggctgggtttcagcttgctgaccacagctctgtcccttgtggaggtgactcactttctctcagttcgccaaccccctttgtcccctctgggccttgagcaagaagccccatccccccatcctgtccttagtgtgcagagaaggaagattctggacttgattacatctggcactgcagagagtgcgacgtgcttaatgaggcatgtaaacgcctggatgactggaactggcaggggaaggggagagagaacgcaaacaaagccaagacggaggggggagactgcagagagaaaaacaaatttctcacattttatctgtgaaattgcagcgacacaaatcagttacattaagagttaagtgtagggcgcagggacaactcataggaatcctgtcatcgcaagtgaaaaaggaaaacgctccagttaagtcaacatctgtgcacagagtttcttcctcaggccaagcctgagccctcttggagcagctgtgactccagcctgcctcgcggctcctgggagccatgagggcgtaatctctattttcttttgctaatggccattcttctagaataaatatacatatcagactggctctctgagccggacttccttctgccagagcctgcaccaggcagcggctctcatctgccctttgctgacctccttctcatgggaaaccatcccacccatgggcagagccctcatcgccgctgccttatcccccacctccctcctcttccccctccatcttctcgttccatgtctgtattagggcgtcttcacaactacacctatccccaggtggctctagctgggacatggagagggggcacaaagactgagcttctcttcagtgcgacctccatgcctcacccgtgccttttcttccctccagccacaggcctctgggagggagaattcgcattgtatctgcctttctcaaacctacttatgcctcagctaccacgatctgtctccctctaacacccgacctcgtctcagtgccagagcccctctcaccccacaatgccccacttctggcttatgtgatataaccgggtggtgactgtctccttaccttcctcagtctgcttctagctcctccggcacctgccctatcagtcttcccgggggtcagcctatggtgagaggggaagggctcttctgtaccttcaggcacccagtggtgaggtatttgttggcctgcattagccttattccggatgctttaaaaatgcagatatgtgagccttgccccagaatcatttaatcgaaatctctagggaaggtcctgagaatgtactttttaagaagctctcccagggaatcctatgcacactgaagattgatggcctctgaacaacagcctgataattcctgaatttgtgtctttagttctctcctgaattctgagctacaagccactctctctccctgaatattccgcaggggtctcaaaggcagcccttctccgctgggaacgctcggggcatgcctcgctcttcccctgcacactctctagaatctctggtcatttttgacttcctcctctccctcactcctcacatctgttagccatcaagtcccaccaaatggcctttcctctgacttctccatctccattatcactcacattgtggcacacgtctcacatggacaattgtgatatcctctcactggttccctcatctttcttcggcaatccaactcctgtcggtttgccacagcagggccaagtgacatttccaaaactcagaatgaaccttgtcatttcgattgctgaaaacttctgcctcccagaacagcttggcattaaggctgttctcgctgtgagatcagcgtagccttatagcttcaagtgtccccagcactccacctgcaaccttccctgcatccaccaggctgggccccctgtgtcccagatcccgttacacatcatgctgttgccactctccatccatccatccatccatccatccatccatccatccatccctccatccattcatctagtcaacaaatatttgtttagtgcctactgtatgccaggaattatactaaggactaaagtaccaggagaaacagaatttctgatcttgcacaaacaagtaaatagacagttacaataaaatataggaagtgccatgcttgaggaatgaagaagctgccagctatcgagtgtcagccacacatggctttagacacataagaacactttgagattgatattgttatcatttttcattggacagaagaagagcctagagctcaaagaacaaatgatgttactgaattcccccaggtaggagggattccaccatggatggaaggggcaagggacagcagcaggttttgtacctaggtctgtctgatcttaatcccctgtttctttcaaacccatatactgtgtctcccagtgtgctggagggtctcagaggcaggcttgtgccctcttctctgcctgatgagtgcatactttctggactctgctcaatgatgccccatatgtaaagcatttgtgagctccgctgaagaatcaatccctcatcttttgggctctcatggtagattacccctatgcttatattttgtttgtgtcattttctgcacttagaagatgtaacactatatcttccagtgagcgttgcccagtaactgtttgttgaattaataaatatatcttccagccaatgagggcatcagttatagcctctatacagtttcatacctttcactaaccaaagaaaagccaaatacccaagaggacttgtagtcccctcccctcagggaagccaaatgactatttttctgactttcccttgcgttctggcctcctgtatgttccaaatctaatttaaaatttagggacccccatcccagatctcccttttgaaggaggctataccacatattccaattctctgtttaggaagacgttcatcacatgatatcttcttgcagagacatcaaaagctgcacatatttgtccatttcctgctgataacgtgtatgatttttatttttcaactccacaatttaaatccaggtgggaagggaatgagtcagagagaaacaccattgcttttggctgatgacagcagcgtaatcatttgtattttcccccaacctgcaaaatgtcaacatagtagaaaaaaactgcagacatttcccatttcattcttgatgaggttccttgtggtttgctcgtaccccgccctcctcgctctgaatcattgacatctggctattagcctgagcatttagaatttaacattgagcgttcagggtgtgctgatgtcagcacagacacagagcttatggttcaacaaagactcaagtcttgtctcttccaggtttgtgatgagctgacggatttgaattaacttctgatattaacttcttaagcttttgtttttgtagtaagcacaaaacagggtgtgttaaggagaacagaagaaagatggttgcctctttatcgactggtttcagttgtgctgcagagcctcgttggttgatcttacttgtgaaacaacacagcgccacgtttgccgctgtaattaaactcaatggaggaaaagttccctttgaagggaagtgatgtgccttcatcagccagcacctctaaaaatagctttatgtttcaccaacaagtgtaacacatacatcatctaattagatttctttgctcctcttttaatcaccaagaacatcattatcctcttggttcctcattaggaaggtcacacagttcataatcatacttacaaaacctatccagatttcagaacaaaaccgtatcttcttagacttcagatatttcattaatctcactgtgctgtcaacaagctcaacttgcctaggggctttttttttcttttcttttttagtgtggtcaccctaccatctgccattttagtagaatttcagctatatagtttatggttgctggagatcgatgtcatattttcattgtaatcatggaaaggaaaaccagtgacacattccaataccttcatggcttgttatatacactacatttttaagcctcaaaatctctcatgaggcaggatctcagcaggaagcttctatatttttttctgagagctctgtgctgagtttgggtactgtgattgtcaacacctgccactcaagagggtggtgagccacccctgaatgcagcagcaaaagcttagtgccaggatggccaggcttgaaattccccgttcttatgtggtaggtgtggctttattctgttttaagccttcaaccaaattttcttctaaaaaatctaatgtttaggccaggcgtggtggctcatgcctgtaattccagcattttgggaggccgaggcgagtgggtcacttgaggctagcagttcaagaccagccttggcaacatggtgaaaccccatctctacaaaaatacaaaaattagccagacatggtggtgcatgcccataatccctgctacttgggaggctgaggcaggagaatcacttgaacctgaaaggcagattcagccgagatcgtgccactgcgctccagcctgggtgacagagtgagactcggtctctaaaaaaaaagtaatggcaaaaaccatgatgacttttgcacaaacctagcaatttaccaagacacgtagcctctcaaaagtagaatttttatttgttcatttttgttgttgttgttgctatgtgtcttacccctgctgagcttcccttgtagctgcatggacctgctctggccataatgtccacacaaatggatccctttgtcatttctgaaacttgtctcttaaccatatctggtctctaactattctttctatattctaaaggaaatcttatttgtctgtatacctgtccccaaagtattttgttgttgtcactgtgttgtcactcagtttattttgtggctttgcatcttcatttcagcttatatttttaaagatgcttaacttcaggcatgaagaagccattaatttttaacattaaaaagggtgaaggaggaggtgctggaataatggtaaagggcataattacatgttctcactttccatttatccctgaaaatatttaattaagcctgatatttgtagcagccattctagttcaattgaattattgctaaccataaatagagaaagagtccttaaatgtggcatttgcccacagaaagtactgggctactgaatacgcttcctcagaatagctgccattcattaggaagattttacctgtggttagcagccacttcaggcctttccagaagggagaaggtcacccaattaccagccagagccaagcttgctttcagctggtgttggagagtaacctttgagaacctagtattctagaacacctctttctttaaaagcagaacccccacacaagatgctgttttatggattagcaattcttgccttagttccaactcacctaatatttcatcatcctttactctgtacttgatgattgcacacaccatcttaactcattctcagagcaatcctgcaagggtagatagaactactccttccacattttatacataaaataaactgtttcagagtagtcggcggtcttgtccaaagtcttcctgctattggatagcagagccagaattcaaattcagttctgactcttaaaatcaatgctcttaagactatccaacaggcaggatgttcctgagatgaaagggatttagggttatttgttccaaatggctttcttcccagaatctctgatggtttaaaaaaaatatttgtctgtttatttgtttatttatttaatcaaggacagaggataagctagctcctcctgaagtttgtgctttttgaaggtatggactgtttctgtctttctttgtgaaagcagagcctagtgcatggcagggatcaattcacatatgttgaatgaacgacttcaacatttcccaaggttggcttggggcccgtctccattgcaggatggacacattaccctttgacctagccaggaagcttggctgtggctggctcccagtgccctgctcaatgccccacatcctccagagccctcacagccagtggtctctctcagctgcaatcttaagctatctcacctctttactcactcccttaccaatacctcaccccaggttcaacatattttggaactatctaaacaagctagtattagtctccactaagaaagggacagggaggtgtgcaggtcctgttccaacagcagttgccatgatcacatgactactttgtaccaggcactctactgattacgttcatccttcaatcagtcctgcaaactcagcatcatcatgcctgttttcagtgagaaaacaggaagtatcttgcctaagatcacagagctggcaacccacagggtcagaatttaaatccaaatgggtccaactccaacattgccagattgcggtcagcgaccttaccccgggggagcgtagagagcatttcctgaggtccctagggatgttttctcagttatgcttccaggaagtctgctccttcgcctttcttccaaacccgtgggcttttatccgggtgcattttagcatcagttttctggaatagaatatgtcattaaaaatctgcctctcagccgggcatggtggcttacacctgtaatccccacactttgggaggctgaggtgggcagatcacgaggtcaggagttcgagaacatcctggctaacgtggtgaaaccccgtctctactaaaaatacaaaaaattagctgggcatggtggcaggcgtctgtagtcccagctacttgggaggatgaggcaggagaacggcgtgaacccaggaggtggagcttgcagtgagccgagatcacgccactgcactccagcctgggcgacagagcgagactccatctaaaaaaaaaaaaaactgcctctagtattctaggttttagagaagaatcacctttcttccaatttttaccaataaatgaataaatacaaacatctgggtttctgaccctatatattgaaattcaaaattgtatcatcttgggtaccaagtacctggagaagtccatgcagctgttaccagccgaggccatgctctaagaaaactgtactcaatctgactctgaagccatgtatgcaagcttcagtgctaccactgctgagctcagcctgaatagttccttcaaaaccatgtcctcccctgtcacacaggtggctctgtagctttgttgagctaacatttacaaaagcctcatggtaacccatgggaccaaacgtgagccccgaggccatgggaccacaccaaattacttaaattgcagcaacccatcacttttatattaaagcagaaaagcatttggccaagttaggtgagcaactgtagcatacagcagcctagtgggagagaactaacccagaaactttcttttcctcatttccagttacacagggctactgcaaagatgcaattaaagaatgagttcattgcccatggcttttgtctcacactcttcaagtctagagagtgtacatagatgtaccagctccaaacacagctggagagccctccggcagagccctcaccgcattggcatttggcccagctgacaagtctcaaatgtgcccaggatctgtatgaggaaagtgatgctagcttcactgtgtatcgtagtggattaaattcattctctggccacaatagcccagccatttctcatacaccaattgaccaaaggcactttggcagtaaattgctatggcatttgatacgacaaagcaggtgctcatcatagctgctgaagaataaaactccctgaagccacatagaaaatggggctgcaaaagggaaactttagggactagagtgttcggtgccctcttgctgtctcaggggagatggaattctgaagtgcaaaaggcacgtgttgacggttttctttcaactgaagaaggctgtctggctactcaccaactatctctcctaacacctggatgcagaatttccattcatgtaataactcagagagctaatagaagaaggacctcacaggtcatcaaaccccatctcttctcaatttgcaatgcgagaagcaaagcccggagagggaacgtcactcagctagggtgcagcacattcatacagagacactgcattcccagtccattgtttctctcacaccatgatactgtggtccctggaaaacctgcacaaatggtcattttctacagagaggaagtagacttgtaacaattaagggcatagattctgaggacagtgacttggttctaatccagctcaaggtgcataagttgcgtggccatagctaagatgtctaactgctctgttcccagttttcctgtttacaaagtgggaatgacagtagcacatagctcatagggttgatgtgatgattaaatgactgattatatgtttagcatttagaatcgtgcttgccacgtggagagcacggtgtgaacgtgtgttgtcatcattgccctaagcaggctgagcagcctacatacctgctaagtctccctttcatttccactcttgagaatgctcaacagaagctgaatatgactgtaaacctccacccagtaagcaccaagcatccgatggcaactgctgctcaccaccagaaacactcatttccttttactattctgcctccttctctctctgagccccactcttccatggtctgttttctgtgtatattgccccactcctctttgctttagctatattcaaccttgggccgatggcatggtatccacaggaatgtttcagttcactggtagaacttgggatagaatgactcctatactcaagagttctgtctagagtggagcatatcagggcttcaattgtttcttaagctcaaaataataattagacaaagacatatatatatacgtatatacatatacacatacaaaactagtctagtatatatgccatatatgtcatgaaaatactttttaagaaaaatatatacaaaaagataattttaaagaaacatatgggccttatgaatctgcccatatgtttctttaaaagtagctttatgtacatatttttatttaaaaatgtaaataaacttatttaaaaacctaaatcactcatctttcaaagacaatatgtagagaattaccttgagcttcaacctgagcatttctagctcagtgcattctgcaggccagtatgatttctcaggatgtgtgccaggactgctggaggccccacagtcaggctactttccatcaatatctatggagcctcctctgggacattaacatgtcgctacaacctggattccgcccttttttgtgaatattctctgacaaaaatgcaggctaatatgagtcagacttcaagctatcaagtaaatatgacttttagtccataaaagcatgtatattttaagtagaaagaaaaggtattcatgttaagattagtggagaggaacagttgtatactcattgctgaagtgagagacgtgactttcccaaagtaaaatgttcccatcagtccctcctgggcaaggcatgaatcctcaccataaggttgacaggcaagccaaatgaactagtcctgtctaaagaggttctgctgcacctcagcttatttccagtaggccaatttgcttctcaaagaagctgtgaagtcctggcttgagatggtagaagaggtgtactgtctcctttgaatctcctttgcttcttcactagttttatagaaatgcctcgtaatggcttttaatcccttggtaataatagattttgctttttctgggatacacttgctgctggctcctagtcttgcgtaccaccctatgtgcttgctgataaaggtgatggaggaacacctggtccaagttagatacacctgcccttgaagcaggctaggataataccaattcatgtgatttgtcttcttgagccatggaaggtgaggggaaaagaacagcactcatgatactgtggacttatttcccggtggaccttgaatgatttattggggatacaggaaggggccagagagagagagagagagaagctagaaaaaaatcaagggagagccccttgggtggaatcttcaggggcagtctgttttgggcatgttgatctgcttcaaggcctttagggaggcagcactgactgctgggacaagcctaattccagcctttaaaacccatggggatgattgttcctccttccttagctgctgcaggaggagcctccacaacacctaggttgcatgcattgaggttgacaagtctgctacatcaacacttggacttatgtctccatccgtctccccttcctaccccaccatctgctccttgcctctctggccttgtgccccccgactcatcattgtctgtactggacactctccaagtatagcacacagttagaggcactgattagaaaacagccagcaggtctgcctttccatgtgttgccttaacctttgggcccacgggcctcaatgactagcctgagcttcacctatttactttttaagcatagtctttcagagcaggctgcattggtcaaggcatcccaacagcttgcccctttgagttcctaaatactcccaatgggctttttcctttgtttagacttggaatggtcagcggaagggtggaaggtgggaagcatgtatgtgtatttgcttgtcagggaagaactatggtgtccttgggtgtatgctaatgggtctgtctctctctcccctacacagggcctggagcagtcattgatggtgtaaactcggcctccagagcactggcttgtctctggctatcagggaccctcttagcccacttcttcatcaagttttga

SEQ ID NO: 36 - DNA, 63527 bp, Homo sapiens
caggcagctgccaggagctcttccctgctcgctcacgcctgctctcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtaagtaggcatttgtttttgctataaccactccccaatatcctccaacccctttcacccccacaacaaccctgttttgtctaaacgttccatcagcaggattgagagaagaaattcagttgtgttgagcttctgggggtgggaggggagcaccatttgacttctaagggatctggagatgaataaatgtgatttgtttatttagttggcaatcctgcaatatgggggctgctaactttccatggaaccaaaaaaaaaaaaaaatggcccttcgctattgaggaaatggaggcattccatggctgaataacaggatcaggttcaagctagccttttttttgtttgtttttattttaggaaattgcacctcatgtacaatccacatatgatgtaacagggtacacattgagacgttgaatgtatttattgtgttttagggtattgctgatggaaaaccaacataatagaatagcaaccagagtggtgaggtgaaatttatcatactgcaggcggggggggtggtataataggacttcattttgcactaagtataatctttttactggcattgtgtgagcactttagctctagtgtcttgggtatttgttttacacttatattttttgtgtgtataggtttaggattttccttgaattccttaaatttgagtgctgttgaaccccatgggaaggtggcatattttgatgattaaagaagttttgttggacaatgggaatcatgtctggaaatctagtggaagatcaatgactgatcactagattgaaagccacttgagtggagctgttgaggacagtgctattttctctgtcgtcagccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtaaagcatgtcctcttgctctcatcagcccccaggctccccccatctcaggaaataaagcagcaaaaaattccaccccccaaatcctttcattctcttatctgccaaatgtgctccctttcttgtaaaatgtagttattccttccagagccaagacatctcttgtgttatttcagatttatggtaagtgtttattcattttttgttcatatctgcataaatgggcaagcaaattgatctttccttgttaaagttttcttacagctggtgaatactaataagcttctaggtggtgacagaaaattcatcttgattattttgggaaggtctttcaaaaattgacaggtatagatttgaggacagaggattggattcactcaaacaagcattcagtttgtacctgctaaggccctgtccctatactaggagttggttataaaaagacaaaattacaaaatccttttctagtatgacagattaattcatcctggtaaatgttatacctgagcattacaaagattgtgagggtgcacaggtggaaacaactaaattctattggggtggagaaggtttgggaatgggactgagaagacaggttaggcaaactgcagaggagagcatttgaattgggcttttaaaggtgagtaaaaacccttcctggcagaccatggagtggggaagggaaggcatttttaaggcaaagggcacacatatgcaaagcatggagagctttaggggagcagcatgactgcaggagagtgtcttttggggaggcgtggctggaaatgagtgactggctgatggcacatctcctgacatgggagtagtccatgaagaatggaggtgggcattcacacaaaggtgggatgggggttatggacacagaagggagaaatagtatcatttcaggtccacctgagacaacctggggttttattatgtgagcttttgtacacggtaagggagagacttggaggccaatgatggagttccctggcttaagagcgaacaatggatcattccatctgtttgatttcccattggcatctgcaggagggcattgtgtgtcttaaccaattggcttcaaccaatcaacagaagaggagccaaagctagataaaggggctgctgattggccagaggttgaatcatttgttttgaaagtgcagagattgtcaataggagaacgtgcaggggtggggtggcagacagagagaattcttaagtgccatcctaaggaactggtaaagcctttaaagataaattctgaacaggcaactaacactaaagagatgagaaggggcaatattaatagagtatgtgctacatgtatatcagagcttcttggttttgaactgcatattagaatcacctggggagattttgaaactcctgctttctagaccatgacccagaacaattgtatcagagtctctgagagtgagacccaggcattaatatgaatgaaatctcccaggtggctcctgcatgcagccaaagttgaggaccattgttttaggtgtgcattaacctgggagtcagggattattcattcatatttgtagatgaaaatttggtgagttatccaagctcacagaaggagtaagtagaaatgttggagtttgaacccagatataagtagaggttgggtaggagaagggagagatattctcttggggctttatgaggccaacagctatagccttgcagatctgcatgtctttaagaagtgtgaaaagaaaagggattgtggtgaggtcatctctcccctagccttctacatgcctgcaggtcatctagagattatcatggtctctgtccccccttactctcccacccacctcccagggctttattctttccttgagagaggaggcaggtctgataaccactgagtatccagtccaggtgcaccagaagctgtcccaaagcctgaaggataatgcattgtctctcatagtgggcctgcatgcatgcaacgtgaagccaattatcctgaaagatccagggcacccagtttgacactctgattgtcatcacacagtctttcaccagggtggcctcagtttcctgtttttttgatatggggaggatcacatctacctcacaatggtcagaacaaagttagatgtggcattatacgtaaagtgcctggtaaaaaaaaaccgcaagaggctgggcatggtggctcatgcctgtaatcccagcactttgggaggctgaggcgggcggatcacaaggtcaggagatcgagaccatcctggcgaacacggtgaaaccgcgtctctactaaaaatacaaaaaaattagccgggcgtggtggtgggtgcctgtagtcccagctacttgggaggctgaggcaggagaatggcgtgaacctgggaggcagagcttgcagtgagctgagattgtgccactgcactccagcctgggcgacagagcgagacactgtctcaaaacaaacaaacaaacaaacaaacaaaaaaacaaactacaagagaatagcgtcaccatttttcaagtgcttcctaaattctaagctatatgtgcacgcgcacgtgcacacacacacacacacaatcactcacacatgtgtgcaattttctttcttcttctcaggaattaataggccccagtgagggagtcactactttggtctgaattttacagaagctgagacacagagtggtaaagtagttccccatagcaaatagctgggaaagcatcctggacatagagcccaggcagtgctgttccagaaccttctacctcagcaggaatgaggagtgagccagcctgggagtccccaggtgtggtctgtggctcaacctcagccactgacccacagtgcgctccattcccctctcttaggtctgtgttctctgagtggaaaattgtattatcagttttctgtgctaatatttagattttagaatctttacaagagtaattacattgtttccctgacatgagaacagatgtgttcaaagtaaattttgctcaagaagccaaaggtcctctaaatgcttagaatagtgtccagatgaccagcaaggactctgaagccacctctttaggtgggttcaaatcccactccaactcttaccagcctgctttggctaagaacttggagggtagtttcttaagttgcctcagcatcagtcttctagtgtatagaatggggacgctaattttgggactcactcacaggacttttgtagaggaggcagagtgagccctgacacagctgtcagctgtcagccctttggttaggctccagtcagatggtgagtacttgaagctaagatggttatcacaaagaaggatatttgaccccaatgtcagatcatggcttttctttttgaaaatgtaaaatacagagtatgcttgtaatactgaaaatcagtattctaagtatcctttagtagtatgaaatctgaatttcaagagaacagcttctggaggctagctggagtcctctcgtggaacgtgtctgaagacttgttccaggccagggaggggactatgcagggcattcaggttatttcagttaatcttcccagtagccttgtgaggtggatctcagtgcacccatttcactcatgaggaaactgaggctcaggacaatatagtggcctgcctaaactttacagatgaagagtggaagggctagggttggaacctcagtgtacttgatgttccaactttttttttctgcattgcactgccttcagtaagaagtctctcattctgggagagtgcttcctcaaactctaggcttcctcatccatggctgccccttgagccctccccctggcaggctcctggacctggaagggacctggactggtcccccagacagaacaccagaggccccagtgctctctccctgcctggtgctggagagactggtgtttgcctcagggaagagcagcaggctcctgagttgcctcctgcctcttctccctttcatgcgactcactgccgccaagcctccacactgcccccaagcctccccagggctgtgccttggtccttctcccatggaaaccttctgcatctcctcaccccacaacatcccatccctgaatcttgaccttgccactccagctctttcaccatctggcctgcgctggcctccattcctttcactcccacgttgcgcctcgaatgttagcgtgccagacctacctgcagcagcggtgctccatgggggcgattctctctccctggggggcagttagcaatgtctggagacatttttcgatgtcacaactagagggaggattctactggcattttatgggtggaggccaggaatggtgctaaatatcctataatgtacaggacacccaagtcccccagtcctgcccctgggtagaattatcctgccccaaatgtcaacagcgccaaggttgggaaaccctgccctagagtcttgcatactccccaggatgttccatgccttcacctccatgaacatgccattccttctgcccagaatgcccttctggctcctttgcttgtatgatgtcaatattaatctttctaaacccagttcagacagcacctctcctgaatgccttccttgaccactgataagtatagctgtagttgtacctattcattcattcgtcgtccatctatccatccatccaccaatccatccatccatctacccatccattcatcatccatccatccatccatccagcaagtcttatagggtaccctctgtgagccaggcactgtgctaggccataggtacacagcaatgaaaagacagcattggccactgctttcatggagcttccagtccaatgagaaagagagacttcaaacaatccatcatacacataaaagcatatagatgcaaattgtgagaagggctattaaggaaagaacaagatgttgtaatgtaaggagagataagacatataggggacctaattataatgacaaggtggtcaggcagcaggcctaactgagccctcagaagggtggaggaacgatcagggggccacattggctggtgatgtcaaatggtggggagagacttaagagatgaggtggggtgggtaccagtttatgtggattgtttgtttttttcaaaaggtatttaaagcaggagagtcacaggatcagagtttgattttggaagattgccctcattgctgtgagccaccctagggacaagggacaggttcagtctcatgcttggtcttctgatctcctctacttctttctgtccaatcagtcctccacgcagcaccagattagtgtcccccaaaacaggggtgactgagttgcctgaagcacccccgatatgggagtagaagaaaggaatgggaggtctgacaccagttagaaggccactactacattcagggaggagagggtagtggggcagtggcagtggggtggggaggctagtggtattgagatgtggtaccaggttgattgggaggagaatttgctttctctgctccatttgcccactagacctgaggccccagctagacctgaggctgtgtcatctcggtagccttaggcctggcctgcagtgggcagtggaaattactggctgatcccctctcttgcctagcttaaaactggactcaatttctctacttggtagctgaggaaatagactcaaatctaggtggctttctccaggccatgggagcaagctcctgaaaagctggaacattagtttgcagacatcaaatttcaggacatgcctttggtgctttgctgcctttggttcatctaagtagccacaataacccaggtgtccccacaagccctgtgacgttgctaccataatccccattttacaggtgcagaaacaggctcagacaggtggaaggctgtcctagggtgcatcaaaggaaaacagtgcagccaagatctgcatgcacgtgtgctgggaagggtggcaggtgtgcagaaagcaaaccatagacaggcacaacccaccttggcagagccacaggggaaccataatcggcaagtctgctgctgcgctctgggcaaacgcttcttttctttctattgattattaagtctttatgcatcttggaggaggtcacttacctgcttgtgggaggagaggaacacagatatttagaaactaatgactaatgtatggcatgctttaaattttgcacagtaggccacatgcacttcatagtcctagagacctgggttcaaatctcagctaagctatttacttactgtgtagctttaggcacattgcttagcatctctgggctttgagtttgttcagccctaaaacaggcaataatatctacctcagagggtgctgatgagggaaacagtgtgacagttgtctaatgggcccagctcagtgcaaggcatactgagggagagcacagatagggtttcctttctttcactgggcatccagaatatgtctcttgaagatgataggtttagaaggagactgcagaattggagcatgctgagaaggatggggtttcacaggtgggtgtggggcggggtggggcctgatgatgctctgcaggggaggcctgaaaggggacctatggctgtcactgaggcctgtgtgccttctgggcctctccctgggctttccgcagtgtttctttttctctccgagacacaggatatgagaaacataggctttccccagggaacaacagaaatgcacatcactgcaggctccaggccctagagccccctggttcttcagagaatctcaagagatgaattgtaaatcatctcaaattgggacaacatctctgattaggcagatccagcaaatagctaatgatcaataaatgtagcaaaaataccttataatttaaaaacacaatcttaaacaaaatatacttttttacctaccaaattggcacaaaaaaatggatatttcctcatgttgacaatactggggcaaacttgtcctcagtttgctcttgttggttatgtaatgtgatgcagtgtttttcagagggtattttgacattgtctgtacaatgtaaactgtgggtagcatttgactggtatgcttttcactggtaggaagttaccctatgggtatatatttcaagtatgcaaaggccactatatattgaaaagaactgggaacaacttggactattccctgagaagggcctggttaactgagctctggcacacgcatgtggaatcctaagcagaggttttgagaatgaggctgatctgcatgcgccagcgtggaaagctataacagacacactgcttcatccaaacagctttaaagagaatggtgtggagtgatcccatttggggaaacacacatagtgtgagcatgttttattcttgtaattcataagacagttttggaaggacacacagaaaactgttaaatgttagggaaatgggaattggggtaggtgcgttccatttgaagaattttattctatactttttatctttttttgtttttaaccataagaatgcgtcgaattttattcatctgtttttagagacaaggtctctctctgtcgtcctgaagctggagtgtagtggtgtgattgtacatagctccctgcagtcgcgaactcttgggctcaagcaatcctcctgcctcagtcccctaagtaactgggactacaggcacatgctaccacacccaggctgatttttaaagacttttaatagacggggccttgttgcccaggctagtctcaaacttctggcctcaactgatccttctgccttggccttccaaagtgctgggattacagatgtaagccactacacctggcctcagattttctattaaaaaaaaatcacccccatttcacagacagtgaatggtctcagggaatggatgtaacttgttcactttgacacacagggagatcactgtgaagccagtgtctctctgtacagggaggtgtcagaatagcacagtttaaattcaaatcctaactccacctacttgcactgtgaccctgggtgagtttattaaccactttgaccctctgtttcctcatgacactagtatctttctctaaggattgttgtaaagataaaatgaggaaaatacatagcaaatgtttatcatagtgtctagtacgtagtagatgcttaatgcaacggagtaattattattgctgttgttcttaacatgatctatttagtcccagaaacaggttccctgtttccggaggtcacagggctaccccaggcagcaaggagaggtgaacagtgacatggtctgggcctctggactgtggaagacccaggtggcagagctatgggctccactgtaatgattccagcctaggcagcttgcctctgttcagagcagaaggagctggaagtcccccgtagaggatcctgtggagagcacctcatcttgccccatgctatgcattgccatagaagtggggagttggctgggcatggtggctcatgcctgtaatcccagcactttgggaagccgaggtgggcggatcacgaggtcaggagatccagaccatcctggctaacacggtgaaaccccatctctactaaaaaaaaaatgtaaaaaattagctgggcgtggtggcaggtgcctatagtcccagctactcgggaggctgaggcaggagaatggtgtgaacccaggaggtggagcttgcagtgagccaagatatcacgccaccgcactccagcctgggcgacagagcgagactctgtctcaaaaaaataaaaataaaaataaaaaagtaagtggggagttatagatttattgaggcagatagttcatttgagaccaacttttatattgcctctgagaaagcaaagcaaaggcccagcaagaaagacaaagtttattccatggaaagagctccagactgagagttggcattcatactagagacctgcttccgactcagtcttactgtgtgacctgtggcaaatccctttcccgctctatgcctcagtctccctatttgtgaattgatgaggttggacaacactgccactaaagtcttttgagcactgacattttaccctgtgttcacggcccaataccaaccttcaaggcccaggaaaaaacttgaatccaaagagggagtgtggagtgaggagcgagaggtgcaaatggggaagttcccaactaaggatgcaggccccatctgggcaacttcaccctctctctttagaaataggatttatttgttcactgattcattccacagtttttatggcctccctattgtgtcttggttccccaggatcagagttcaagtgttaggtggcacttggaactgagcttaggttcaagtctgggctctgcctcctagtggccatgtgaagttatgaagtcatttctgctctctgggactcaggctccttatctgtaaaatgggaataattacctttacctcatagaatgattgaaaagatttgctgagatacaggatgtaaagtgtttggcacagtgccaggcacatagtgggtacctttacaaaaaacccaaaaccatgatcaataggaaagagtatggtattcttgagtttgaatgtagctcaacccgaggccagtcatttgatcacaggcaagcgactgaactctcagaggctaaatttcctcacctgaaaaatgggaataatcataatgattttgaaggagagaactgaggcttggagagaatgttgtcaggagaattatgagaattgaatgagtccacatcagcagggcacctggcaccgtgcctggctcacagtagggattcagtgccagccatttattgtcctggctctgaacctgtctctttgctccagggatgatgggtatagcttagatctatttttggactgtgcaagtccagctcataaaaatacaatcttgctccttgtcagcacttctgcacttgtatttattgttcctgccaatcctgggacctctccatgtgggaacgtcttcattattgataatcctgggaagtagtattttaaatttttatgatctgtactttgcactgtctgaaccaccatgtattatctggccttgccagtgacacgggaattatatccagacaaggggtcctttagggatgaataatttatcccattttcacaatgccaattatattaaattatgttcttcatattagcagctgacaggacaatggggatccaatgtgtaaatatggaaagaaaacaaagttatttctttgcccaaatccacagtcatatttgaaaacctggagtttcatttttccaaatatccataaaaccccacttttaagaataaaaagagtaggagaaattttgcccctcccctctctacttttcttctctcatttctgctgatagacaaggcgctcagggctctgttttgctccattttcttttaactgcgggaaaaagaagaatgtctagaagagaggctttctttgcaaatttatttttctcctgtcttgttctctttgcctatgcgagctgattcctccaaggtacaattaataacgattggctaacatttcttaatgctttccctttcagagtactaaaaaaaaggaactgtgactttatcgtttatggaagggaaatgtttctggctctactccacaggaacaaaacactaagctttatgaaagtcctctagctggctggttgtagtgactttgtagggttgtattttccctgctctctgccggtccccatgcagtgtaccttcactgtggccagaggcctctcctgtgcctgaaatgcatacctgcaaagccgttttctcatttataatcattcctcagctcttcactgccctcacattaatcttcaaggtgcctagcatggcattcagagcctctgtgtgcctctctagcttcctccctgtcacctactcacctcacccatcctgttccctggccacttaaaactgcttctctgtagttgcctcaggtgctggcctcccggatgtcttctgaaggtttgctggtattgtctctccctcgatctagagggatctttcccctgggtttggaaacaaggaagctggccagggcaaaggtccaaagagagatgaccatgtcctatattggggtagaggccgtgcaactggatgagtgggttgatttaagggaaatttttgaggaagctggagctggaatgggtggaataatggaatgaattttgagactaaagggaagggaggaatcatgagagattctgtgtttgatttgacataaacagtagtttggataatgctgctgttatcttctaagttggggattacatggcatgaagatgttgagagtgaggtggctggggcaggagggtcaagggtgaatgttcagtagggtcatctgagtgttgagtgatatctgagtggaagtaaatatttgggagtcatgaggataaacaatgaacttgattagccaggtgtggtggcacatgcctgtagtccaaactactcaggaggctgagacaggagaatttcttgaacccaaaaggtagaggttgcagtgagctgagatcatgccactgcactccagcctgggcaaaagagcgagactctgtaaaaaacaaacaaacaaagaaacaaaaaaaccaatgaacttggaagtgatgggagtgagaacatgcagagggggcttgtagatggaaagaagagtggtcatgagctggctttgagaaatcccaacactgagagatcagaaagaggaggagcctggagtggagacggaggagggctgctgggtgagccagcaacagaaccaagagagaggctgccatgggcccaagggaggagaacctttcaaggaggagagagagaacaagcttgtcaaaaatgactgagaggtcaaagaagatgaaggcagagcactgtccatttgttccaggcaaacaggccaagaccttttgaaatggagatggagttccaaagagctaacacttcctcggggtgaagacaaaatattgtgtagcagcctgagttgcttttggagaaaatgtggcttagctaaagaaaacagcagatgactgaggacccacatggtatcaggcacctgcctgtctcttggcctgtatttgaactttgtggtttgaggagtgaggacctgaagctaaagggactattttcattagaaagtcactcaaagcctaagtagcatttcataagggttcagagcaaagcaggacatggatttgaagagagggttatggtcccaactctgcctaatttcagtaccctctaaccccatgactgcaaatggtgagtggcatatttttatgataaacatattatacatataaattattatatgtatacttgaagttgatgtaaatgacatcacgcagtatataaaaacctcttggtatctaatttcttttgttcaatgtaatgtctatgaaattcatcaatgtatatgtagtatagcggtgaggcattccattttctgagtaaaccacaatttatccattctcctattagtgtacatttgagatgttcccagtttggggctatcaggaacaaagctgctatgaatgttcttgtatcttttggtggacccattatgtttttgagctgactttttgctgacacctaggaaatctattgattttggtttacttatttagtatttggctaccttactaaattctaatcacttttcagttcattttcttgggttttcttggaagacatgtgtatcagatagaaagcttttagtttcaagtaacagaaaacccagccaaaattatattaaggctcaaagagtaggtatttgcccctataactgtggatcccagagtaggtctaacttcaggcaaggtgcaatcccggggtaggatgtcatctggacccagctccatttctctgggttcctcttggctctgcccttctttgtgtgctgccttgttcttctcctggttcccatcaagatggcaacaattccaggactaaagtcttcagcataccatccagaggaagaatcactcatgaagacctacaaggcttctttcatcaagacactagtcaatactacctcatagctcattggtccaaattgggtaacatgcccatgtctgagtcaatcaaattgtgtgatcaataggatggtatgccctgattggctcaacttcactagggaccatcactgtcactaaggaagtggtcaatcccactgaaccacatggctgccacacagtgaggcaggggtgggttcccaaaaggaatatcatagcgcttttggttgaagaaggagatggatgctagagaagcaacctcaaaatatttattattatgagaataaaaatgatattgcctgtaatgattattcatggtcttgttctgacagtaatatttttcagttctgtctcctgtctcaacatgttggttagaatatggggtcttttaagtttacagagaatggaaacggttttcagatttttcaaaagctctgggaaggatgtttataaaaatagagagggagcgagaaagactaagaagcaagtacttcttaatattttttttttttaaatttactagtctctgagtttgcatccaacatttgatgtgaggattctcaagaacagttggaggactgtggatctagaaaggaagggatcaagccaagagatgatggaaatagacttggcaatgtgggaaggtggactagttttcaattgctgtgtgacaaattaccaaaaattaagtggcttaaaacccataaacttattatctcacagttttcgtaggtcagaagtccagccataggctagctgggttctctgcaccagggtctcatgagcccgaaatcaaggtgttggccaggctgcattcccactgacacttgagatcttctttcaagctcattgaggctgtcgacagatttcagttccttgtggttggaggactgaggtcctggttttcttgttggctcttggttgagggttgccctcaggtactagctgcatggctgtctttcagcatgtcagtttaattcttcaaggtcagtggagaatctctttccagtctgttaccctggagttttacatagcacaatgtaatcatgggagggactagcccatcataaccacaggtccagcccacatcctaaagggaggaaattatacagcacatgaacaccatggggcaggaatctttggagccaaattagaatgctgcctaccccaaaaagcaattattaccccaaggcttgtggctcatgctgaccaagaaatacatatattatatatattaatagatatgttacatgtatatattacacacacacacacatatatacatacacacatgcatggggagataaaattaaaattgtaaatccaagtttgtgaatatttctaaaatcgtggattaagagaaataatcagacatctaaattttctgtaccacttcataatctgacagttgatctagtgatgtccaaaatatttctaataactggaatttgtagaatatccttttagttcacaaagcacctgcatgtatgttctttcatttggtccatcccagaatgctgtgaactagcctaggagctttaccatttgctcttttgtttacatcagcttccgactctcgtattcgcattgcagttcacatgccagcaaagcaagttcttgtagatcacatgctatttcacacttttgtttctttggctctgtggtacactttgcagagactgtcttcccttgttttgtccacccaggaaacttctattcatcttccaaaactcttttttttctttttttgagacagagtgttgctctgtcgccaggctggagtgcagtggcacaatcttggctcactgcaacctctacctcccgggttcaagtgattctcctgcctcagcctcctgagtagctgggattacaggtgtgcgccaccatgcccagctaatttttttaatttttagtaaatatggggtttcaccatgttggccagggtggtcttgatctcttgaccccatgatccacccgcctcagcctcccaaagggctgggattacaggcgggagccactgtgccgagcccccaaacttttttttttttttttttttttaggcagggaagttgggggcattcttgaatgcccatgttcctgagaagtccttgtgttgctcttgataggctaggtagggtgacactgcagcctgacaggtgcaaggctccactctacagctgcctcagtatctatggaagaaaatgtgatagcacccagatgttattggattaatgttctgaatgtctaacttgcatcaactcatttatgcctcccaacaatccaacgaggtggtcatggtgatttccccattttatagatgagaaaatcaagacacagaaggcatcatcaactcacccaaggtcaccagctagtaagttctggagccaggatttgaactcagcccacacttgtacactcccctacaatattgacaatattggtatctgctttatagtgtagaattaagtgaggtaaggcatgccaaatgctcaatgcctgctatatagtaaatgcacaaagtatgagaattatttttcttatctgtggtacaagagcttctgttttcctattctttggcctagtgggtaggaagaaaataaaaataacagagcatccttctgcccccaccccctgtaagctctcatccatgtttggctgtgttgcttccctgtttgaggaagccaggggctctctttttgttgtttggaggaacagattgcaaagagggcaggaaacaacagcagaatttccatccagaaatgggttctagaggtaagagagggtggggtgctgatgggctggggtccagggcctccttaacccccataagtccagccataggttagttgggtttaggtaccacctggtagatgttccgtgtatggtagcgccgtccctatcccttcctttttgagctgcattgagtccatgacatgcctcacagatgttaaaggacattcttcatagaagaattcttgctctagttaatacgcttgactgttgtctccagggaaggttggtgggcgttttcagtgaaaattctgttaatttgagccataatgggaagtaggagtgatcatggttagaagattacttcattttagctgtgtgaccctggacaagtgacttagcatctctgagcttgagtttccttgttaggagaatggaaatagtagtgataggtaggtgaggcatatgaagtgcttgatctagttctggcatataataagtggttcaaaaatattgctcattatcatctcacttaactctcaaagcaaccttacaaaatagggatatgaattagaattatttgtctctattttacagatgagaccctgaggcttagacagcttctgtgttcctcatggcactgcagcacttggcaatagttattgattatctgtcaggtttctttttctttcactttgcctgcacagtgggatggagttacataaatgtcttgtcaggttgacagcatatcttgataagatgttaaccacctctgcaaaaatattcagactttagaaaaataagatgatacaacagattcaacagaactttctatttttcttctcacaagtccccaaatcaaattggaattaagtgtgtgtgcaaaggcttagaaacagaatcttcatcataactttctattttattttattttattttattttattttattttattttattttatttatttacatatttatttatttaatttttgtgggtacatggtatatatatttttggggtacaggagatattttgatacaggcatgcaatgtgaagcacatcatggagaatggggtatttatcccctccatcccctccatttatcctttgagttacaaacaatcccataacttgtttatataaccaaaactggaggcaacctaaacgtgtaacaattaaagtttaattagatcagttgcagtacacacatgcagtgaaatgttatactatgccaaaaggcaaaatacaatgatatatttgtttacattggaaaattggagaaaaatatagtgttgtgtgataaaagcaggttataaactataaagtatgaattcatctcataaaatatatattttcacaaatagtaaatatataacaatatgtacatatataagtctatataaatatctaaaaaggtataatcaaagttgttacctagggttgtctctgttggaatggggaagtattatgagtaacttgaattttctcttacgtgtgtttgaaggggggttctttatttttttgatctttatgtcatgtgtaataaattctggttactgaaaaaaaagaaaggaaaatgtttcaagtctccatgcatgctaacacactggttgactctttcaggtgattgtgaagacaagaacggaatatcagccggaacagaagaacaaagggaagttccgggtgccgaaaatcgctgaatttacggtcagtttcttgatggtgtaatagaaagagtaaaggagaggctggctccagccagctcagcacacctcgtgcttggagcaagtactgctgtgggtggggaaatgatgcaggctatttctggaggatttcttgaagccatacagtctggccactgagtttaatcaaataacaagaactctgcctctgaggtctatcatattctcgtgtactctggaatgttctgataaatctcataattgataaatgcctcttctattccttctcctttctcctgttcccttcttcctgctttttcatcacaatctccaggaaatgtgatggaaatgcagtaagtgactcacattttagtccttcgttgcaacaaatatgagaaaaacaaaggtggggggaagaaaagctggcttcttggtggtgaaaccctaatggttggcttcctatttcttggtggaggggccgcgaggagcactggagaatatgttgctagctgtgatgaattgcatcaaggatccacaaagcattctctgtgagggtgaaagaggaatcccagggaatgccccgaggaagtcacttaggagctgaggtgggtggggaagtgggtatgaagcaggtacaaggtgcttgcagctgaggagagtgcagcttgtgcaaaggccctgaggcaggaaggaggctagccccaaccctgaatagaaacagaaatagaaaccctgaatagaaataaggacagtgagggccgggcacggcggctcacgcctgtaatcccagcactttgggaggctgagtcggatggatcacgaggtcaggagatcgagaccatcctggctaacacggtgaaaccccacctctactaaaaatacaaaaaattagctgggcgtagtggcgggcgcctgtaatcccatctactcgggaggctgaggcaggagaatggagtgaaccagggaggcagagcttgcagtgagccaagatcgcaccactgcactccagcctggatgacagagcaagactccgtctcaaaaaaaaaaaaagaaataaggacagtgaggccgggctctaggagggtgcagggagcagacacagatgaggcagaagtgggcggagggcagacagttccaagcattgaaggctgtatgaaggcatttagggtttaatactaaaagcaacaggaagcctttgaaggacttcaggaagagaagggacatgattacatttgggttttagaaaaagtatgctggcttttacatggctaatggagtgtggtggatgaaaggggatggaggggcactattaggctactgcagtcattcaagtgaaaaaacacacaaaaaacggtggcagatcagataagggtggccagtgggtggagagatgcaggcagatctaaaatatttaggaggcaaacaatcagccctggaggcagtagaacaagtggtcctgtggatggatgatgcagcagcctggctgggcttgagccttggttccaccttatcctagctgtgtggccacaagcgagtcactaagcctcacttatcaaatggagataatagtagggttgctatgacgatgaagtacaaagtacctgcaaagcacttggatctgtataagtgcgcaatagtagcctttttatgtcaactgtgactgggagctttgaaagtgaacatgactcgtggttggttatctgggaattgaagcgtatgcggggagaaacatgtgggtttgtttgtctttgactatttttctccccactaaatcaatactgaagcagctgcgtatgtggcccaggggaggagtgtggtccctctgtgtgcattccctggaatgtggaacttcctagatgccaccctcctcttggagagcagtggctggtcttacttttttattgtactttcagtgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagactttcaacaactttcttgtgatttcataaatgagaacacatccatatgatgaactactttacagtttcttaagaattaccttttttccctcagagagtagttttctctaaattatatgtatatgagatactttcatctaatttttacttctctatgctttccaaattttatgcaatgtgcacttaattatttcaataatcagacaaaaatgagaattatttttaagtgtgcttttttaaaaaaaaacagagtgttaggcatttttaatgaaattatcctttatccagcagtcatttgaaatgatggctgtgtcacgaggtcaggagatcgagaccgtcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaagaaatgatggctgtgaagtgcaataatttgggcaaatacttaaagagagaatgttgagtgagtaaaatagagattaagattgtatgctttctaggattggagctatgaaaaattacaaataaatgtattaatattaaaatgctgtctatggctgtgttattagcagtgatatagggctatatattttttttgtcttctttgacaacttttggtgatgtggctactttttcatatctatgtgagagattgatataatcccctatggctccgagaggtgacataacatgctgacccaccagcaagtggcagagccagggcctggcggcctctctgctcagccatgatgcctgcagtaggtaactgctgggtagaacagaaatgagtcagctaagagaaaaagggtgctgggtcagggaccagggcctgtagaagttctccacccccgcgcagtttgactcaattagtcttgggggtcaggaaagaagggctttgtggttcaggggcagccctctgtcagccctgtcaggcatgggcagagggggacctgcacttgaagcaaaatgggaggaatggagcagattctcttatgcttatgtaaagctgcaagaattaattagcctggtttttcactttcttaaagagagctccttctgggccccatgaaggatgcacctgcaggtgcagaggtggatgcagggaggctagggaggaggcgtggaggtaattaagaagagtctgagggtctgagctgagtaagctggctggggctcatgatccagggaggggctgttatggaggtggaatttacaggacttgctcctggttggaggaagggcattgggggactctttggtgtttggcttgtctacctgccactgaggtagggagctggggggatgctctgagtgtgaggtgcctggagaccatgggtggggagggggaagacaggtggtctggccacccttggaactaataggtttggagctcaggatggagatttccactggagaactagggctggagtcagggaatttacagttagagagcttggtgctgttacacagtcactgggtcaccctgcagatatattgcccggggctgagggaaccttggaaactgcaaaggtgcaccccttctcattccaatcccttcatggatctgggacagcttgtgatttgaatttcaaaattaacctggagaaagcagttcatggcaattattctgtaagagagaaaagaagggagcagggtggggagagatgaatagagaaagatgagctgaaataattgcctggaatttttgtcatttctgaaactaaggaggccctgcagtcattgtaaagggccacagacttgaaatattttcatcagggttatgtgagaaaatgggaaaatgcagagaaaaaaaccctcctttcttaatctgagagcaaggggttctctaaaactgattttgctatggatggtgctggtgctgtggtgggtgtttgcgtcatgggatcctggtgctgtggaaggtgctggtgatgttgggggtgctggtttcctggtgatcctggtgctgtggaaggtgctggtgctatatagggttctggtgtcacggtgatcctggtgctatggaaggtgctggtgctatggagggtgctggtgtcatagtgattctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcgtgggaatcctggtgctatggaaggtgctggtgctgtggaaggtgctggtgtcatggggatcctggtgctgtggaaggtgctagtactatggagggtgctggtgtcttggtgatcctggtgctatggagagtgctggtgtcatggtgatcctggtgctatggagggtgctggtgctgtggaaggtgttggtgctatggaggtgatcctggtgctgtggagggtgctgatgtcacggtgaccctggtgctgtggagggtgctggtgtgatggtgatcttgctgctgtggagggtgcttgtatcatggtgatcctggtgctatggaggcagctggtgccaaggagagtgctggtgctctaaaggttactggtgctctgaaggttgttggtgctatggaagatgctggtgctgaggagggtactgaggctctggaaggtgcttatgcacctagctatgctgccaggcctggttgtttccaggttcgtctgtgagttggagctgagtttggatttggaagtcattggtgctaagctgtggagaggcacagctgtcctccagggagatacctgggcttgagactaggctcgcctaggcatcttagatcttggctttgccatatcttagcttcatgaccttgggaaaaatctctccactcccaagttcccaacttttcattaataaaaccagacaataataatgaatagtctgtctttggtgcacgctaggggcttaataaattatcattttctttctttcctatttatatcctttttcttcctcttgtgttcttagcttcctgtctaattagctggattttgtttgttggttgggctctgggcctctctttgcaggcttttctccctgggaatgtgactgggagaacctggaggaacatttcaaggggtagccagttcattgtcaggattcatgggtggtctctggcttcccacagtgattcctggaggcacgtgtttgcttgttggtaaaggtaggccatttttttttttttttttttttgagacaaggtcttactttgtcaccaagactggagtgcactagcatgatcatggctcactgcagccttgacctcccaggctcaagtgatcctcccaccttagcctcccaaagagctgggactacaggcacaagccaccatgctcggctaatttaaaaaggtttttctttttttggtagagatagggtctcactttgttgctcaggctggtttgaactcctggcttcaagcgatcctcctgcctcggcctcccaaagttctgggattacaggtgtgagccatcatgccccgtctggtcatttttttcgtgggctattttttagtacttcagttataagacaaataataataatgtcttaaatatgcttttacatctacttttcagcctaacaacaatcttgggaagtaggtacttttattatccccattttacaggtgaggaaactaatgcttagagaagtgaggtgattttcccaaggtcacttagccaggaaatgtcagaacaaagcaagaacccagcttcatggctccatatcccattctctctgccacaacttgatgtcaccctgccattgtcctggccaagctgtgaccttcctgccttctttccttccttcttggtctccctcccttttcttctttgtcgttattaatattggttctggtctgggctcaatgcctgttgctgggagatacaaaaatggataaaacaaaacctctgccctgaaggagctaacaaatgtgtggatcagatgagaaacattctgtgcagcttctcagctgtgctcttcctggagtcagcaactctgggaccccttcctgatcctctagctggatttggggcctcctctgggctctgtagggtcatgaggcctcctttcccactgtcctctgcctggcctatcccgcacctgcagccccctctagcttctgatccctggagggcagggaggtgtctggtgcatctctgtgttcccagttcccagcactggcctggcatggagcaggctttgggtgtgttgcattgtgggccctgtctcttgggatggtctcaggagcatccctgaccccacaccctgatccagcattcagagaatctgcctcattaggctctggccagggccagctcagactggagggtgtgtaggcacttgggaaggatcctgggaatgcctgcagtccagacctagagcacatccagtggggagaagctgcagtgggagggacaccttagcccaaagggaccagagctcaccattctctcattaaaatgaggtgggaccaagaactggaaatgagagggtcagtcctttttaaacaaccagtggctcatgcctgttatcctagcacttcgggaagccaaggtgggtggatcacgaggtcaggagacggagaccatcctggccaacatggtgaaacaccgtctctactaaaatacaaaaattagcctggtgtggtggcacgcacctataggtcccagctacttgggaggctgaggcaggggaattgcttgaacccgagaggtgcggcttgcagtgagctgagatcgcaccactgcactccagcctgacgacagagcaagactcagtaacaacaacagcaacaacagaagaaccagtgtcagtgggctattattaaacaaacagcaacaagtaaaacaaaaataaaaccccagttgcagtttcaggctaacattagaaggtgtggatttttgctgtttcatccgctcaccgatccattccactctttgggctcctgcctgtgactagcactttatgtgcactaccccgctgaatggtcccagcacgtcaggctggcgggattgttaccccacttgcatatgaggaacacaggctcagagaggcagagcgagccatctgaggtccacaccctggaggctgtgcagctgggccacctgcccgggtagacagggtcagggaaggttgctcaaatggaaggggatccccggctacacaggaatggctcctaaggatgctgctgagctcacttacctgccagtggctccttctcctttccttttataatctagggccaagaaatgggggccttggctccctgtctcaagcctcaaccctgctcacgttccctccaacactaacaggagaagaagcagggagaaacacagaaaccagcctcctcagtgctggccgctgcacctagcagccatagagccaggcccctctccctctggaagtctctagtgactgtcctttcttctctgttctcactccaacactctggttcaacccacatcaccacctgtcccagccctctccctgatccctggcccctttcctcagcagccccagtcctttctcctccccttctagagcacatgccccacagtggcatttctgtgcctccattgcttacctgcctctcccataggtgcatccacctcccagaagcagtggcccttccctcatgatcctgtccattggatgtctccctgcctttgtctgtgtcatccttcctagctggattgtctttcctgcctgccatggggccatctccctattcatccctcaacaccaaatgcacatggcctgggcctgtgcagtgttgcttgcactgacatgcaaagcctgtcctttctcctttgggttcctgcatgtcctataggaccctccattctagtaccaattaaacagagttggcatcagtgagttacctactaggtctcctgctgactggaccaggagctcttgtacccttctctgtaccctaagaagctagccagcacctggccggatgaagcagtaaaaaatgcccttaataaatgaataaggctgggtgtggtggctcacacctgtaatcctagcactttggaaggccaaggtgggaggattgcttgaacccaggagtttgagaccagcctgggcaacatggcaaaaccccatctctacaaaaaatgcaaaaaattaactggatgtggttatgcatgcctgtggtcccagctgctcaggaggctgaggcaggaggatcatctgagcctgggaggttgaggctgcagtgagccggattgtgccactgcactccaacctgggtaacagagtgagatcctgtctcaaatgaatgaatgaatgaatgaatgcataaggaggtgaatgagcaaacaaaaaaaatccgtatggctgaccaagaaactccacatcgatcacatcaacagctctggttgcctcatttccagtatctttatataaaatcagggccctatcttttcttctgaactcttgctgataacacatcctcataactctcttcctgatgccacattcttaagaagttagacaacatttctagcttcaccatttgcttctaccaatttttcatcaaaactccagggccttcattccatgggattctaatatttgctgacagcagcaaatggagataagcgattttactttattatctgttgtcttggtttttattgctctctctttcttttaaattttgaggaacatttttaggcaagttattaaaaacactgcctgctgggttaggagcagagtcattatttggcatggaaagaatttgcacatgaggacttggtggagaaaggctgccagagtgtttcatgtttattatttcacttctggccagggttttattgaaaatcagactgaagatgctggcctatgtttttgtccaggtgctttcgcctggctttgtgagtgtactattagaatgaccttcaaaaatgtatgctgttattaattgatagttgcaaagcaatcgtggcttaattttttaacgaaacattcctctgagacagaaaacacacattgtgctgccttaggaggaatgtgcatagggtttgatgagagacggggtgattcaatgaccaccccatcgcaaaaggatgggcttttattaccggctttacattctcattgatccaaacaaacattgttaagtaaatgctgcaataaagcaagtcacttgttaataaacatagtgtagaagaagacttctagggtatagtgagcactcttgtttcctatgggactcctgcaggggtgggctggagtaactcacacccactcctgagagctgattcttccaagtttgcaagccagttgtgaaactgttggaagcttgaaatcaatcatggtgggagtgtttacaccatggaaatcagcaaaggctacaaatctcctcctctccccccaagagctggtctctcagcacaccactgtggaaaggcgatatggaagaaacacatgggttaggggtttgatcccatgggtttgtgaactggaacatgtcatttcagctctctgaacctgcgtttcccaatctgcaaaatgggtggcgaaggctccatcatagacctagtgtgaggcctaagtgaggcaatgtaagctaacacagttgttccactgtggctcgataaacgtgagcttcctcttgtagctgcatggtagttttatttctggggagggaggtctcttgctagatggatgctgccacctagcttgggtctccagtgggaagctacgcctggtacctgtgggcctccatcccaggtgacgctgccgtagctcagttgctcctcttggcttaccctttccactgtgccagctcccagctctccatctctgtcccaccccttcacgcaatatgagaaaaaccagattacgtcatcagatcactctcctgcttgagaaatctgcgatatctccctgcttcctaggggctgcagtgtgatgtccttagtacggcactgcaggctcttccaaaggtgggccttgctgctgattcctgtccctctgccactgccttcctacactcccagtgttctggggctctcatagcactgcaaaactgccatgccttttcatacttccagcattgcccatgcagtgtcctctgcctccattgccatccatgttttctgcttggagaccccgcttagagctcatctcccctggaactggtccttgactccccactttcatacctggaagtcctaggttcctagcattacaacttttccttctcttcctgcacctcactgctgagatggcacatcggctttcctagagttctgctacctagctggattgctgaaggtgccactgaaaagagggcttcctaaaggtttctcaaatccttggttggagtaataaaaggaagatacagaaagtaaaacaacattttaaaaataattatttgcagtaataaataataacagctttattttattaaacttctattatgtgccagatagcctgtgagtcatttcccattttatctttattgtaactcatgaaataggcatatttttaatatacggatgagaaagctggggatcagcatgattaattaagccactcggggtcatacagccaataagggggcagagtcggggttttctgacccagagcggtatgtgcaccgatgtgtggttatgtgtatgtgtgtgcatgcatacacgtatattcttttatctataccatcttccaaattgggaaaccctgcacatttggggaattggctaaattaagctaaactgaaatgtggttgcaagaatactaaaactttgctgcagatccctgttatttgccgagtgttaggttaattttgcgttggctctctcgtcctcttttttctctttaaatacactgtttggccgagtcctgaaatgtgttgatccaaaagggaaaaagagaagcgacaatttcccaagaaagagatgccgttttccccagggtctgtcatgccacctgctccgcaatcccagtcacaaggtgggagagctcatctcctggcttcctcgctctctgggcctttgctcctgcaatgcatgattatattaaatgtgattcttaaaaaattgatgatgtttaagctcctggaactgtcagaagaaggccctaataagatgactgtatgtgcagcttttcatgttgccagtaggttctataattataagaaaatgagttgttatagcaactgccatgtaggcctcgcttcctcctggggatgctgagcgctcagctctgtgatccaagtaactgggagggaatttggttctttaaggggtttcaaccctcacttgggtgatcatcattcattcattctaattcttgacaacctgaacccagttttactttgcaatctgacagacctggtttgaatgttagttctataactcactggactgtgtgaccttgggcaagtcacctcacctccatcagcctcagtttttacttctgtaaaatggggatgccagtgcccaccaattgagagagccattgtgatgatggtgcttgggatgtggctagcacagcgcccggcatgcagtagcccctaaaatagacgggacacattccccttaacttctttcactgggagcaaatgaaaaatgaaaatgctacaagtagggagggtaggtgttttcatagtctttaaaaaagtattgtcattaatttgggtagcatttgtggcttgaaaaccaggctactgaacagaaattccaggctgaatcatgtacaagatatgagacagggaaaaaaagagagacgaagagagagagaaaaaaagctaaatataaatgaatatttagctaatgaaactgacttgaatgaaaactccaactttactttatattgcatttctctgaggctaagaaaaaaaaatttctaatttctaaaagaatctccaaactgagtcaagaaacctggtttctggtctcaatctttgggcctcagttttcccatctgtaaaatgaggtagttgggtgagttcatccccaagaggcctggaacaatcgttctcagtcagaggtgattttgtttctcagaggacacttggcaatatctggagacagttttggttgtcacagctgggggtagggatgctattggtctctagtgggtagaggccagagatgcagctaaacaccctatgatacataggacagctccttacaacaaagcattttccagccccaaatgctgagaaaccttgctctaggatttaccagcatgttcgctgggtctaaaaccagaaatcaaaccatagtcacgccaccaaggataagtcagatttgttcagtatttcagtgtcttatcctagcaatctcccagagatttgaagccttagaaaaattagaaaaggtaaagacaaaaagacttctcaaggttgtaggaagctcaataaaaaaatgagatggccacaggaagtgcgatactgcacaaccctaaacagacccaatatgattgttttgtgcacaaagcaaaatgtacttgatgcaattttaggtctataaatagctttattttttttgtataaaggaggataaaaataaatcttgcagatatttcaactgcccttctcatttccagctcctctcttcggttttgacatgtcaagccacagtcagagtgtgtctcttctgaaactcacaggcaatcacttcctttccctgcttcaaaccattctggggcttctcttgatcattagggtaaaatctgaactccttcacctgctatatacttggtctctcgagcctgtctcttgctcatctcttcagtctcctccgaacaagctaaattacctgtcgaattctcgacacactggacccgatttcatctctactcctccgcttagctgttctttctactccgaatgcttttctcttcccacagtctggtggccacctattcatctcataaaactggctgggacatcacctcctttcctagtagctgcacctctcttcctcattttcagaaaggactgaccatttcctttctgggactttaatcactgggcagaattggtcatctttccctccttcatgcagttatttcctttcctgcgtttttctggtgctatgaaagcctgggctcttgcggacagaaactgccctgattcagttttatagccccgtatgcctatacattctggggccttgaatacagtaggtggtcagtaacctttgttttaaaataagaataacatacaaatgcacaacattctaacagtacagaaaggcattcactgagaaattaaagtctccctttccctccttcatagttctcacaaaaaatatctgttgtctacatctgtgctgtccaaattggaagcccctagccacctgtggctatatacatttaaattggtcaaaacaaaatacaatttaaagtttaatttctatcacactagccacatttcaagtacttagtagccatgtgagcctagtgactaccatatgggacagctcaaatttagagaacatttccatcattgcagaaagttctgttagtccaggagcagcttcctatgttcctatgatctcatccagggacatttcctaaaggtcttatatgtacagtacacgcacacacaccacacacacacacacacagacacacacacacacacttaaacttgatttcctcattcatcttttcaaatgtaaccattgtatacacattctcttgtaccttgcttctttctcttaataatatatctcagagatctttccacatcagcacattgagatcctttttcttcctgttaatggttgtagacagaggatgtttcatcatctttctcaattagtccacgattgttctagctttcagccttctgctgctgaaatcaagctgcagtgaacctccttccagtgaactacatgcactactacagtttgaatgtttgtgttttcccacaaattccgatgttgaaatgctaacccccaagttcatattagttattaggaggtggggcctttgggaagtgattaggtcacgggggtggagctctcatgaatgggcttagtgtctttataacagaggccccaagaagcttgatctacccttccaccatgtgaggacacagatagaaggcaccatctatgaaccagaaagtgggcccatcccagataccaaatctcctggtgccttcatcttaggtctctcaactttcagaactgtgagaaataaatgtctgttgtttctaagctatccagtctatggtattttcttataacagcccaaatggactaagacacacgcacacacacacatgcacacgcacacccctttcatatgttctgcaagtgtaagtggagggcatgagagtcttcaatcttaaaaaccttgccagagggtatatacaccttcccttttaattaataaattttgccaaattaccttccaaatatgttccaccagtctatactcccccaacagtgcctaagcgtgagctgctcctccccgtgtgctggcaccaggttttaaccaactctaagtcctacccatctgataggtaggaaatggcccttcctcttgaagtctgcatgtctttctctctctttctctctctctctctctttttttttttttagatggagtcttgctctgtcgcccaggctggagtacagtggtgcaatctcagctcactgcaacctctgcctcccgggctcaagcgattctcctgcctcagcttcctgagtagctgggaatgcagacgcctgccaccccacctagctaatttttgtatttttagtagagacggggtttcaccatgttggccaggctggtctcgaactcctgaccttgtgatcagcctgcctcaacctcccaaagtgctgggattacaggcgtgagccaccatgcctggccatgcacatctttcattatcagtgagtttgagcttctttttgggttcttattgcctgtttgatcattggttcttttctggaaaaattcttatctggctggaccatttgttccttcctcctgatttgtgttgctacctcccaaagctacagacttagtttttctcccttgtttgttatttcctcagtcgtcctttgccttttggttttgtttatggtgtaactgcttttttcattctacaatatttctaacttttgctttaactcaaattaatcatggactccacaaggcatgagggaaaatattgatacatttgactttaaaaattaaggccatctcccaccctaaatttatgttttcttctggtgcttttatgattgtgttttatatgttacaattttgattcatttggaatttgtctctgtgtgaagagcaagctgggaatccaagtttatttgtttttgaatggcagtttgtcaggtgttctaagatcatttattaatcttttccctctctgacttgacatacaacctttaaaaaagctactgcatttccatatgggtttcagtctacttctgttctctcttttcttctattgaactgactgttttttgttattgtataccaaattctttcagttacagctttgttacacatctttatatctgtgtaaattattcttctctcattcctttcactccttacccattcttgcatttcacttttgcaggtaaatatatatatttatatatgttatatatatataaaatgttatatataaccctatatataaattaaccttattatatataaccatatgtatgtggatattttactactgttactgtttacttggattacataaatttatagatttcaatttgaggagatgctacgtctttaaaatattgagattttctttctttccctctttctttctttccctctttctttctttccctctttctttctttctctctctctctctctctctctctttcttttctttcttttctttcttttctttcttgacagagtctgttctgtcgtccaggctggggtacagtggtgtgatcttggctcactgcaacctccacctcccgggttcaagtgatggttgtgcctcagcctcctgagtagctgggattacaggcacgtgccactacacctggctaatttttgtattttttagtaaagatggggttttaccatattggccaggctggtcttaaattcctgatctcaggtgatccgcccgccttggtctcccaaagtgctaggattacagatgtgagccaccacgcctggcgtaaaatattgagattttctatctagaagcaagattgcatctgttgaagactttcatcactttcagttgagctgtaagatcatttttgcagttcttgttaaatttattccaaagtattttacctgttttttttttgttgttgatattgtacaaggaatcttttcttttgttgttttttaactgggtattatttatacttaataaaaatgcttttgaattttgtatatttatttgcctccagttaccaacttctcttattatttctaataatttctttaaaattttgattctttatgtttataaggaatatacaattgttccatctgcctgtaattctaatattgctcctctttttctgatatttagttttcttatgttatttcctgtttgcaatttttagactcctgatgtcattttcctgtctaattgcagtggtcagtactttcagatttgctatttctagtgttttagcatttacattttgatgtttttttcccccccaaataccctttctgcatttacggacatggtgatatggtttgtcttctttgacttggcattatgataaattatactaatatattttcagatattaagccattcttacatgtcctcatttggtcatggtgtaccatggagttctgtttgctaatacattactgtatttaaaatttttgctttattaatattgtgaggttgtgttgagatttactttttgtgctgtcttcatcaggtctggtattaatgtcattctgcctctgtaaaaagaatgtacgagcatttttttaaaaagaatgtgcaggcagatcatgaggtcaggagatcaagaccatcctggctaacaaggtgaaaccccatctctactaaaaatacaaaaaattagccagatgtggtggtgggcacctgtagtcccagttacttgggaggctgaggcaggagaatggcatgaacccgggaggcagagcttgcagtgagccaagatggcaccactgcactccagcctgagcagcagtgagactccgactcaaaaaaaaaaaaaaaaaaaaagagagagaatgtacatgcatttttctttctccatgtcctggaaaatttgacagtagagaaataatctgtttctttatatattttttaaaaacagaattaacccacaaaatcatcttagcatttggaaggatgtgggtagttttcagtaaatatgtgaagaattaacgtacaaataaatttcatttgtacccgaccacctgtctgaagctttgaaagattacatttagaaatgcacccattgccattctcttaattgtaactcccttcagcaattttttcgagtggccccattcagtcaataagtgtttacacagtagcttccatgtccggagccttggggtagatggtatggatgattcatggaagtacaagacgtggcttacaatttaatgttcccagggtgcggacatacagctgaagcttctgtttatgtgaatttgattctaaagcaatatcatttatcattgaatattaatggagcagtatttgcagattaccctttaggcttacattagtcatccttggatttagagttcagtagctcagtccaggctgcacacactgagccagcacatggtctttccttcttgcatcagagtctggcttccctccctgttgcaggtctgcagagtagagcatgttgattgctctgtggggtgtggctctgccactggctccctgtgtgactcacttctcttccatgaatttgggtctttcacctgtgagatggagacaccgatcttactttgtcatacttagatagtatatgtaaagcatcaaaacacagttggcacccagaaaatctacatttacctcctcgttttggtatctcccaaaatagctagctgagtactgggctatgaagtactatggggtatgggacagttgttcaagtctagattatttttagagcccttgactggtcttcctgcttccaaaatccactccttccagtcaatttccatccaagctgccaaagtgattttaaaaacgccaatggaaccatgtccatgaatgccggatatgacagacccactggctctctagtgcccccagtaaactcttcagtctgaaccttatgctccttcctcaggcttcctctgcttaccatccaagacttgtctttcactgtcatgggccactccaacgtccacaccctggggcaggctgttctctccacctggatcccccttttactctctccttccaggctggcccaggagccccactccccagtgccatctccatcacatcgcttctcaccttgccttctatgagtctttcctgagagccgacaccacgtatacgtcatccctgactcccatgtgcctggcccagggccagcgaagggctaggcattcagcttgtatctattgtccagtgaacaattaggctttggcttgcatggtaaaatatgaatgacattttctccattttagttctctggggatccctgggggaaattgttctttataacagaaatgaggccaggaaaatcaattgtgtttctcggctgcaggagatgatggaacagcgtaactttcctgaatatcccagggcacagcactataacagagtggcaagaggtggactgtgctggaggcccctttcattcttacgtgcatttcaagccaagctcaggcgagaactcaccattcagctgcccactgctcatgaaattcaggagctggcgtgcttgcaaagcttccttgcaaagctccttttttctttttaggtcataatgagctggttgggcagctgcttggttgccaatgactttatagttaaacacccacactccaagactctgccttcagtaaatggagggagaacaaaagaccgcaagaaagacaggagaatgaacattgatacagcatcttctgggttctaggcacagtgactgctgcatttgtctacttccttgacctgcataagtgccctgtgatggggacattattgtaatcactccctttgtacagaagatagagaatgagagagaagtgacttgtccaaggccacatgcgttagataggggccatttgtgtgtcttctgagcaatcagtttgcttttatcttctggactctatgaatattatcgccgacccatttcctatcattggtcaggtttctggaaaaccttgagctatatgtcttgcccgcctgctgcaagtagggacactgttaacatacctgcctccaacttatggccatcctttttccttccatttcctccattactatttttctcatctataaaatgggaataacagtaattatactgatcacaatattgttgtggagaaaccaagcaaagtgctcagggcagaattgggcacagtgtgaacactcaacgtggagcctgtcagttgccagaagtcatttctggaaaaagaggaaagtgtaataaagataagatgagcgaaacaagttaggtggcattttatacttagcataggtttatcaagcacctactgcaaccaagtcctggccagatgcaggggctatagagatgagtcctcagggcctcgggcctcaaggagcaagcggttcagtcaaaacccaggtctgccacaggtgaatgtcaaactggctttctcagctggcctgatgcgagttccttccacggagcctgtagtgaagagcattccatgctctctgcatctcctgtcctgctttattttctgtgtccaggaagcagcccagatctgaagctcacctccagccatgtggtttgtccatagcccctcaaagaagagctttgcataaaggaagacacccctgggctgacgccccaccctcggttgtgaggccccattcatcctgccagggctacggggtcacagttgaataagcacacaaacaggggacccaatttgcagctgcggcaggcagatcggctgagggaagataatttcattaggttccaggctcttgctctaatgctctgtggcgatgtctctgtggccttgcaggctggctgtgcgtgcactcctgtgtctactggataattttcttgtctttgtacagtcagaatggtggataaggatgtgcacgtccatcttttttggagccaggaagagtgggtgaaatgcaagagtctgatttctgctctgatcaaaccatgggaaagttaattaaggctgtgactcaccagaccatcttgatgaaattaagcagtgcagccaggcctctggctattttagtggcaggaagtcaaatggttggctctgttggtgactccataagtgtatatttaaataataatgacagtaataatatccaacatttatgggagctttacatccagcatctttggaagtccacccaatgtacctagtaggtaggtgttatgattcagataaggagatgcagataaggagactgaggctcagagaggtggcgtcgtgtactgaaggtaacacagccaggaaattgtggagcagagattaaatcctagtttgatggtaaggcctattctccttttcccacctcacactggttctctttcaggttcctgcatcccagtctctgaacagccaaaactaaactgctatatcatctgtatcctgaacgcttgctagcccttcattttcttaatagcaaattaaaattatcatcatggcagcagtaaataagcttcatgacctcactgctccaagcccatttgcctgcattttgggacaaatttgtagctacaatcattgcctgtggaaacagcaagactgtgcgatgacatcttaatttcccgagtttcactttgtacaaaatgaccctggtgagacttgtgagggttttcttgtttggatcatttttcccaaacgctagtgattgacaagtttgcggatgaaagctccacatcccaggccagaggaaggcctaggtgtattgagcaaatgtcagaaagaagagactccacctgacctggctgtgcgaggctaggaagtcctttcaccttgccacagtcagatggggattaatgacatcttcgtcaaaccgttgttgttattttggacttaaactaaagcaatgcacgcaaagcccagctcctggcttacagggatgctcaatgaatattaggtccttctcctctacattctcaaatccctcctttgtggtagatggtggcctgtacatatttggagattttttgtggacacatgtttcagacccgtttaaccccctgccctgccctgtcaagtacctggccacaggagcccatggtgccagctggaagccagctcctggctcagccccagacaagtcacactcctggcctcaccctgggccttgttgaacagattggggtgattgctggctaactgaccccgggccaatcactttctggaaacttatttcctctaaaatagggataaaaagcccaaccagacagggttgttgaaaggcttaatgcaagtaacaaaagaaagtaatgaaagcaccatccccaagttaaaaactgggaaacttcatgtaatttcatgatctctacctttcttgaaaaatcagatcagccatgttagaatctcattcccgtccttgacaacgattgtctggagctgtgcagctgctgtcccctgtcaatgaggcaggttccctctaggtcccgagcatgccacagcagccttcttcactcattggtggtgtgtgcctgctccctgcttgcacagagaaggtcaccaggccaggttggctcctttcctctcaacaggtcggtgagatctaggtaaacaggtttccatctatgacacacttgcttttgctttgttgccttataaaggcacaaccttgtgagttaaggcctcagcttctccatcctgtaagaggttcactgtcaaaggtcttagtattctctggcccatgttgagtgatgacttgaacttttaaaatgaaaaacatttcgggagcccagagatttatctcctacatcggcagggccctcggaccctcgctcttcttcctaacgattataccacagcacattaatttgggaaatgaattactgctttggaatgttccagttcaaactgtgctttttctctttcaaggattccacaaatattaatgagtttctggctctacacccaggaatcacacttctacacccctccttcttcccatggggagctttcctctctgggttctgaaagagattcctgaattattgctcatataaagtttgaggccatagatgtttcattttccttttactttcaaaaggcaatttacttagtgagattcattggggccctagagaatgggcttctttaatgggttttggggggcttccatggggagctgaccaaacattatgataatgcaatctttttggtttgcggatggagagaaccggtgtattccatgctgcaacaatcatacagccactccagaggctgtggagtgagtagaaggtgcacatggcctttatggtcacacctgaattcaaatcctggctactccattcattaattgagtttccttataggcaggtgacttaactactccgtgtttcattttcttcatgtataaaacaggaaaaatgacaggctctaccttatagagttggttttaaaaattattagcaagaaatgaggctgagcattgtggctcatgcttgtaatcccagcactttgggaggctgaggtaggagggttacttgaagccaagagtttgagaccagcctgggaaacacagtgagactccatctctacaaaaaaataataaaaaaaaaatagctgggcatagtggtgcacccctgcaagtcctcctacttgcaggaggctgaggtgggaggatcgcttgtgcctgggaggctgaggctgcagtgagccaagatcgcaccactgcactccagactgggtaacagagggagaccctgtgtcaaaaaaaaaaaaaattgttaacaagaaatgaagttaaaataactacatcatgttttataaattctaatatgcatcttaagcctttccagtgaaatcatcttggatatgagagcacagcccacagacaaagccaactccttctctagggattgaccctagagaattgaggtctctaattctgtctaattgagggattagacagaacaatgggcagtaaacaggccctccacagatgttacctcccatacctgtcttgccattttagggttgtcatttctatccaagagaggatctttacaggaattcttctgatatattgacttagatgccatttactgaacacatactgtttcagaccgaagccagacaggtgagctccataatctcattccacctttcggcgttttggggtgtgagagaacattctagttcctgttttatgaatgaagaaactgaggcttagagatatcacaaaagttgttcaaagtcgcacaggtggtaatagtgggagaagctgcaggcggagagtccgtctgtccccagaggctatactggctccagaccagctctggccagtaatgaaggctgtcttcagcctcattccagtatttcacaacaccccaaggaaacgattccttttcttctgattaggccaaatagaccaacagaaacatcatgatcaccctggttatctcctattctcagatatgtgcatgagtctgataaatccaaaacaggagaatgaattcattcgtattgaataaatgcagtctgtttggcatgaaaaaaactcatttgaaacatgggaactatgggacagggagaggaacaagactttagatcctaaggcatgttccttctcccagatccttggtctctgggcacctgctctatgccaggcgctgggcttggcatttccacacaatgatttcatttcctccttacatccgtgcttcaaggtggctattaggattctcgtttccagataagacagctgagcccaggaaatgtaataagagacccagaaagtgatgggtgggaatctcagcaagggtgtttctggcttcaggacaaagctgaggtcaagacctggtttttctctttatcaggacagaacagatggatgcaaaggtgaagtcacagtgaaacatacttcctggcctgggaacatgtgggctttgagggcagacttggcttctaggtattatttaaaggtgaaattggtaagccccttgaaggggctgagtggatgtggaatcagccatgacccccatctgcataccgatactgacagggatcagaaaggggctttgggttctggaatcccaccactcttgccttctaaggctcactgacaaggaggtctgtctataaggactagccccaaatggcaaagaactgctgtattcacctggcaagcatccctaactccgaggggcagcacctccagtaagcaaagctggggttgaggctcagggtggggtcctcaatgaatttacagattcctgtcctgttgtgcccaccttcgccccaaagagggatctcatcctgcagtgcaaggaggcagtccaaagtgtacgccgccaccagagggaaacccatgaggtggaaggtaggagagggtgtatttttttttccatgtctagtgtcaggctcactgaaagatagctgaagtcaggatgccacagggaaggagaggaagagcgtcttactcttcctgcacagaggagcctggcccaaaaaagataccccaggcttctccgtgcaggaagaataagatccctaccctcatcctgacccacgaggaaagaaggaaaggaagagtttgtggggattttgttgtttgcatgtttgagacagttcttgcttgatttgttgcccaggctggggtgcacgactcactgtagcctcaaactccctgggctcaagtgatcctcccagctcagcctcctgagtagctgggactacaggtgtacactaccacctccggctagtttttacttttttcttttttgtagagatgggattttgctatgttgcccaggctggtcttgaactcctggcctcaagtaatactcctgcctcgacctcccaaagtgctgggattataggcatgagccaccacacccagccaggatgagatgttagtggggcctgggctctgggaggcaggaagagaaaggcaaagggctggaacctggtgcctgccttttaaggcacagggtccccagtaaagcatagctcgttacaagtttgactctgaaaaataagatatggaatgccttctcctgccttcacattgggcacaggggcagctgtgttgacggtccccaagaccatccccaggttcaataattcaccaggaggactcacagcactcagcatatggctgtatgcatggctgtgatctcttacagcaaagggatacgcagcaaaatcagcaaaagaaaagaaaaaaagagcatgaggcaacgtcgaggggaaaccaggcacaaccttccaagaatcgtctcccagtggagtcatggaggatgcgcttcattcccgcagcagtttcagaggcgcgtgggcaacgtccgccagggaagcttgttagagactgtctccagggttttcactgggggctggtcacataggcactgtttgcttagcacccacccaagtttcagactccaggtgttcaacataagccatattgtaagtacaagttaggcagggtgagccactcctatcagttctggggatggtgggaacattcttaaaatccagcttcccagacaccagccaaggggccagtcttgcatgcagacctttccaggggtaccaatctcaggctggctgtgtgaactgttttgtgtgaaaacgccctccaagactcctcccaggtaaggtgtgtctgtgtgtatttgttcagggcagtggggtggggaggtagaagacagggtagagattccttcctcctcatggacaaggtagcaaattgagcacgggggcagaaatgccgtcttccccaacatggctgacttatgtccagaggagatactgctgggtgtgctagactgtggtattagcagaattattcttatccttgcaagaattacagggagacatggagtagtttatctggcaggggaacccccactggaatgcctagcagtgccacacattgaaatttgggaatgatatttaattttccaaaccaactttgctgatctgattctttcttttcttcttccttccccttcttcttccttttttttttttttttttttccatcaacttttctgccaagaaaggggattaaggaatggaagtagcttaatggaacaagctatttgggctgccgggctcatgtctccatggagatggtaatgcaggctgtgtctagacagacggttggcggggatgcagtgagacagttgtgcgcctctgactggagccgagatctgcacggatggccctctgggctgagggggatagtctggccctgctatggggcctgtctcttggggttggatggagcaactagatgtgagttcttcttccgagttcacctgtgtgccctttgtgcaggcccaggccaagagctgggcaggcggccaccgaggcacaggccctactcttgaggagctcatggactgctagggcaggctgatgtgttacgtggctgtgatagcacatgtgatgtgtggctgcagctggaactgatggccttgggagcctggggggatggggggcttgctcaaaggggaagtctgggaaggcttcctggtgtgtgtgtggagcaccctctaagtgggaggccgtgggaggcatgccagtagcagacagcctagaactttcaggaactaggactggtgtgtgtgtgtgtgtgtgtgtgtgtgtgtgtgtgtgtgtgtctggggcaggaacaattagtgaagtgggacaggtaagcagggaccagatgatggaaatagcacagtgccaaggaaataatacgtgttttggatccaggcaaacctggcttctaggtcttgctttactactaattggctggataatccattatttaatccacaatttacccaacatctgcaagcctcagttttgccatctgaaaaccaggaatatcaacagtcctcactttatggaatcctgggtaggacttagtgagatgatacttgtcaagtgctgagtagctgatgatttaaggatgtgagtttcttgccctcctttattcagaagccagacaaaggattttgaacattgtcttgttccaatgacagtctccaggctacttgcattcaaacctcctggatttgtgtggaaaatgctgatttctgggtgttatcatagaacagggggatcagaatctatgtgtactcaggactctgcatcttaccattctctttagatggttctgatgcttagtcaagtcatagacctgctgtgccaggagatgggaagtcagggggagggctttcagccccaccatgcaatgttcagaagagtaatttaagaagatagctttggtggccaatagggagaatagttagggtcggggatgcaggaggggtcagagaggaaatgatccctgtcaaaggtgcttttctgccccattaatatgaatcatcagcaaaacccttaaagggtggggcccttgggccctggggaaggtcaaacacagagggtatggccctgcccttgaggggctgtcagttggttggggaggacggatcacagatgtaatacagtgtaatacccaggcaacacagagtaatacccagtggcttcgtgctgaggcgatagtcgaaccaaattcataaatcctgcataattacaaaaataacaacaatgacaacaagaagcattaatttgtcactttagcatttacatgactctctttccttttgcattaatcatcttgcttgtacctcatgatagtttttcgtacattagcgcactgatttagagccattgtgtaggtggtggggtcaaggcttgtcttgattctgaggtggcccagactcggcacgtgaggatgctctatgtgactatacaaagttggaggggccacagtgtgtaaaatgggatggaacagaaggaatcaagatttaagctgggatccatgtagatgggaacaagaagcaagcctgtaaaaacatatgggggattgatggcaggattgtaataagtgtttttccttttggattttcaatattgttcttataataatggtgcaatatatttttaataaaaatgaactgtaatgttattgtaggtttataggcagtctaacatatggttaaccagctgggcttctgagtgagacaggtctgagttataatcctcaccctgcccctcacatatgtaaggtctttccatctatctctgatacaacattgtacaatgggcacactgatagcacctacttcatggagttgcagggccatgaagtattgaaatgtatgtaagcattccatgtatgctaattaactaaaggcattcccgggaaaggctgagcatctactaggataggctaggcctatcctgagggcttttatgcactaccacgccccgccatccaacagctattgtgaagcagccatcagtgtcacctacctttcagagaagtaagctgaggattccaaagggtaagcaactttcccaggttcattggtgagcaggtggcgagctgtgctttcagtctagaccttctggcttcgaaggctctgcttcattcactacttggtactaggggaagggctaaaaagaacccaggtgtcatctgggcagaatttacagaggttgcaacccctttgaactttctgctcaagccctattgtcaggatctttggggctcagccaggaacaaggtgccgggaggcctaattctgtctctggaggttccagctgccacatacagaaggcaaatgtctgtttggccgccctgtttttatttccccacaaagtttaatttccctgatgtgagtggttctattgctttgaagtttccagggtttgcattcttcataaaaaagactggtttatggtgcactgtggtgctaagatgtggcagtacctgagtgttaatgaagttcatgtttcctgacatgatgagggtcctagatcagcatcctggcttgacagtggaagggtttttggttttctccactgtcttcctaattcctgaggtttctacctgggtggtgacatatcttcctagaataagtttacagtatgcatcgtgcatggtatcttgcttcgttgcactattacaagcaaatgtagctgcaggacaggaaaatatgtatcacaacgccaattaaggtatggttagggttgagggctttagaatgagatactctagagttctaagcaggctgtactccttcaggaaccatgtggcctcagacaagttactaaacctctctgtgcttcagtttctacagctataaaatgggggtaataattcagcttccagggctatcatgaggtttaaaggagatcacacataaaaatcactcgccaaatgccttgctcattattgaatagtcaataagtgattgttattatcaggtaagcccataggctgggccagtaataccaggcaatttataggcaccatctcatttaatcttcacagcaatcctatggggtgggattgatttttctggtccccatttaacagatgaagaaaaaggggctcagagagatgaagcatcttacccaaggtcacacagctcatcagaagcagaagcgagattgactcctgtcacgatgtggccatagttacctcagagaactgcctaaatactttccagaatgcagggtccagctctcccagctgtgagagagaagcttctcatctttgaggggcacagcaggcagacaaagaggccacttcagggtcaactaaggattcttccagcatcagacaaactatacttcagatgaccatatgcagtgatttcatccaactgggttcttcccttcagtcactctgccaagctgtagaacagttaagacgggtcctgaaaactcactgcagccagtgctttgtaccaaaagtgaggataaggtgtgggctagggaatgaattagcctctcccctatcccatgccaggtcatgagttggaagttgggaataagatttggtccctgtccacatgacacacgcaatgaacaattgtgatccagtgggctgagtgctaagtggtagatggatgcacaaagtgtaatgagagcaaaactaggcaaaggaaggcttctcagaggaggtgacatggtgagttgggctttgaagcatgactaggagttcaccaaggggagagtggctgaaaagatatgcaagagcagttcatacggcagtcttcctgagtggttggagcttttgaagtgcatgctgaggagcatggcagacaatatgggggaagagaggagtccgcatttgtagcacgtataccaggcactgtgggagggcgctgtattcatttcctggagctgccaaaacaaatgaccataaactgtgcggctgaatgcaacagaaacttgttctctcacagttcagggtgtcagacatccactgctgaggtgctggcagggccacatttcctctgaagtctccagggaagaatctctcctttcctctttgggcttgtggtgagcgcaggtgttcccaggcttgtggatgcatcactcaaatcccgcctcccgttttcatgtggcttctcttctttctgtgggtctgtctccctccgtgtgtctctaataggggcactgcttgaattcagggcctgcctgcataatccaggatgatttcatctcaagattcttaactaaattacatctgcaaaggccccttttctaaataagatcacattgacaggttctggagatttggatgtgggcatgtatttcaggggccaccactcgacccactttcaggtcccacatgcattatcccacgtaaccctcagaactccgagagacagatgttgttacaattcccctttgacagaaaaggaaactcaaaagattaaaggtagactttatgcaagcagggattcccctgtcctctttttatgcccaatgtgtgcagttatctctgacacactgtaggtgctcagttaataattagtgaataaaatatctcagcccaagctttatgaggaggatagcataggctaagagcccaggccacactacatagaactagatgcctggctggattacttaatgagctgtgtgaccttgagaaaattatgcaacctttctgtgccttagtcttctcatctgaaaaatgaggatacaataccacctacctcatagggctgttgtaaggtttgcaagagcaaatccatgtacagtgccaagaacagtgcctggcacaatcagtgcctagtaaatggaagtgagaagtattaccccacactgtgtcccaagaggggcggcagacaggtgaggttaattaaagtgccctaggagaagtgtcttgaagagctgtgatcagacagcgtagcggctcaacattgcctgaggacttctggggagactttggggaggaggagatagttgagctgagtctagggtgagcagggacttgacaggctgaggagtgggaactggcattctaggcagagaccagcagctgcaagatcatgggggtggggaaaactggggtacctggagcttggagggccagggttggggctgaaaagggaatggaggttaaatccaaaaatgccttgtctgctctggcagacaagagatgagccctcatcctgtaggtgtggtggctcgttcatcagggaggcagtgtgaccaagctggcttgttggagagtctagggcggactggaagcctagaggctggaggcccaggagcagtgaggctgctgcacccaggggagaggtgatggtggtctggccagggggcttatgatgaatatgggggcagggggagataaataagctgtgtcagaggcagaagctgccagagctggtgtctgcctaggcatggctctgggggaaaagtggaggcaggggtcgctgcagagtcaggccccagatgcggtgggcagcgctgcctcctgccacggctgaggctggtcaggggcatggtgaggtcaagatgcccatgatataacttggtgccttttctcgacttacctcttaccaactggggaaccttggggaagtcacttcacctctcagagcctcactttctccatcagcaaaatggggataataattctacttcgtatgattgtgacgatagtgtgcactacgttcccaataactcttagcatctgttgttattgttacgactcctgccactgtgattagatggagggagggtggtggggcagcggtcgctgtgactgtagtcccggcacatctttgccagagtcgccaactctgtgctctattttgaattcttcctctcttctgtcttggatctcacaagcctgaagaggaatcttgggtgcatcttcatgggtgccagcccaaaccctgattctcctcaaggttaaggtgcttttgttgggcacatgtgtggggtggcggggttgaggagagggaagagaacaggaggagacatgcaggtgcttccgtgcaccactacacctgcacacggcacggtttgggccaggttgccgtctgtctgcttgtggatgtctggggggaggctgtgtgtgtgtatgtgtgtatgtctgtgtgtgtgtgtctttctcagtgtgtgtgtctctgtatgtgtgtaactatatgtgtgtgtctgtatgtctctgtgtgtgtaactgtgtgtgtgtctgtgtgtgtgtaactgtgtgtgtgtctgtgtttctctctgtgtgtgtctctgtgtgtgtgtttctctctcagtgagtgtgtgtgtgaatatctgtgtctctgtctgtgtaactgtgtgtgtctttttgtgtgtgtttgtctctgtgtgtgtctctgtgtctgtgtgtgtgtctgtgtctctgtgtgtgtacctttctctcagtgtgtgtgtctctgtgtgtgtgtgtaactgtgtgtgtgagtgtgtctctttgtgtgtgtctgtgtgtgtgtgtgtgtgtgtatgagtgtctgtgtgtctgtctctctggtcttaattcaactcaacactgcaggtcaggaaatgtttctgatccccactttgtatgagtcactactgggcacagagaaaagggtgcgactcgcttgctgcccgaggccttcccagcagaaggtggctggtaggcgagaggggtgatggggatgcagtgtgctcctatggaggaggaactggagcaggccccagctacacagcagggatggattaggggttcagggctggagctgaatgctgaggagatgttctccttgctgaggaaaggcacacaggggctccaggcctggcccaaggcccagagaagcaactgcaggagctgtcagggtgctggggctggaggggacagtgtgaaccagtggggagaggtacatgagactggagggtggttgagggggtgcaggctgagcaaagatgttaccccgacagcaccagggctgcctctgtggggagctactgtcttgggcaggacaagggtgatattggcctccaaagccctagggggctggaccctgctttccttccagcctcacctcagcgttctctccttgtccccttcgtcacagccagactgcttcttccaggccctctggaacctcgagctcctcttccttgtaggatctctgggcgtcctagaatgctgcaatgctctggcccggggttgcctggagcccagtcccctctcgcttccaggaccaccccgtcaaagggcccccctcgtgtgctctgttcagaccacattcagtgcttggtttgtggttatttctttggtgaattgctcattgaatgtctcactctctccctcctgtgaactccttgaggcaatggctgtgcacagcatccggctcacagtaggccctttagtagactctcagtgagcggacgatgagtggctgagtgagtggatgaggggagacgggtgcagagagggtgattccgtggtgaggactgtgcctgtaatgaaaccctccaatgtagcgctggagaactagcgagctgtttatcgcgaggctcaggttgttaaattcaagaagtgaaaccaagggctttagaacgtctctgaggatggaggttatataaaccgagtcaataaatattgatgtggagtccggctttcatgttcagaggtgctttgtggggaggtgggagtttctctccccgaccctcttaggctcacccggcatggcgggagctttgttgcagggatcaggcacgtaggcccctgaatttcacaaatccaccagaaagggaggccggggaggctgggtccagcaggatgcctcgcagaactgaaacctgcctgtaggaaatctcgccctggaaccaaaccaggactctccagctcccgccccaccccagcaaccattgacaactgcatcatccagaatccagaaagctcaccagtggaactcgccggcctgagccggcccttcctcctcttgtctcgcagtgctgtgctcacctcttatgccatcttaggccattgactccaccccactgccccgtctggcctcagcacctgggacacgccctactacatcagccttcccactggcccccttgccttcagccatccccctgcaaacatgcctcctgttgcccccagagacatcactccaaaacataattctcaccttgtcgcttccctgcttagaactgtcactggctccctgttgtccttgagatcaagtccaagtgtaatctgttctttgccccctgcccaggcccccaggcttccccatcactcacaccccttgggccagccatgccaaggcctgtgatgcctctagaacagcctgtgtgctctccacgttctttccagggctgatgccatttcctctgctcagagccttcttcccctcatcctaatgttcttccatgaagtcacttatgatgtcacatcccccaggaggacgtccctgatgcccccgcccccaggttgattaggtccagcagccccctgtgctgatggcctcagtcatggtgtcacctctgcgttgcaagtgtctacacccatcagtccatctcttcctccccctgtagactgtgaggtctcaagaaagagcctgtgcctgattcaccacaacgtactctctgacctccccagactcttagggaatgattggccttcagttgcagaagttaccaaaattcaggacagggaggcaaactctccttcagctaagacagcctccattgagcctaattctggggtcatggagcatgtggggtggcctggcagaagttagccctgcttgggcagaatcccatgggctgggctgcacccgtagcaaccagtcagcattagacccttgactctgacagtcacggaggacaccccagcaagtgtcagcacacaggactgcttgcatgtggggaaccacgtgggggcttcgaaacatgctgaggcctggactgcacccccagagattctggtgtagttggtttgagatagggctagagctccaggatcatttgaaacgtttgaatcccaggggattctaacatgtgcagctgcttgagaaccactcacagctagtcctactagagcagcgcttctcttcctggttacacacggtaattacctggacagccttgtcctggacccatggaattagaatccatgggggtggtgacaacctaggcatcagcatttccgagctcctcagctgcttctaatgtgaagcagggtttgaaaccactacctccaacgtacctccctccctcccttttctttttccagaagcatttgctggaggcctgctctgtgctcgtgctctctagccctggtggtgctttggtgaatcagcccctgcagttcctatttgggatttcttaactcaggggacgttagcagtggaagagctcaccctgtaaagggaacctgtcccacaggcaggcttgctgggtcctgcaccagctcctagtgcccctttactaacctgctgttggccaggggccttatccagccctgtctgggcacgtccatacccatgttgggaggtcttgcccagctcctgagtctctcaagaggcctgggactctgcctaggcaaggtttggggttgcacatggtcattgggatgggaagctttccagcagctccctcagaccctgcatcaggctggaggcaatggcaggctggggctgaggctctgaactccctcctgagcatgcacgagctcgacagctgcactgtagtctgtggatgagcctgcgactataggcaactctcttggctgggcccaggtgtgttctctttgaggggaggggatgccagcaggattttaatatccctttaacagaaagggtcaccacttaggaaattggctccctgtccctagggcagagctgcaggtgccaggatgctgcctgaactctgggcatttatttttaaaaactaagagaaaactcgtgtaacataaacataatgactttaaagtgagcagtgcagtggcatttagtgcatccataatgttgtgcaaccatcacctctgtctagtttcaaaatgttttcatcacaccaaaaggaaaccctataccccttatcagtcattccccattcccccagaccccctagtcctagcgggctccagtctgcacctgcctctgtgcatttcctcattctgggagtctcatcagatggaatcacatgacatgtggccattggcgtctgggttctttggctcagcatcacgtttgaagggccgtctgcatctgcagctggtccttcattccctttcatggctgaataacattccgctgcatggatagaccacaatttgtttattcattcatcagcagatggaaatttgggctgtttctaccttttggctattgggaaatctgagcatttaaaatttttttatatctctactccaaacacatgttgatcatgtgttcctaggtcctcagcatttgtgagtcgtggtcttgggtggcctcctttcctgtactattcaaataggagtttcctagggtgcatatgtgtcttcatggtatctcttgctttaagtccaacttctcttgatttctccacctcagctccacctcttgcctgtgtgataccggactgatctctgcaccatctcatcccatactgttatcactccaatccagggcaggaggctgataagcatgcaacaggcttcaacttctggcttggggtaatggagagaatggacagcacatggtgtcaacagtagcttaaaattgaatgttacacagtactgtcctaaaacttcatatacacactcattaggaattgctcatggacggtgtctgcccatgagatttggacagaatcctcccgacatccatcttcctcttttccttttcaaattcctcccgtccagtatttaaaactgccaacagacaactccatatttttggagcaatgtaaactcctgtctcctcctttccttataaacatgccctggggtgggaaagagatggcatgggcactcccaaagttaattttactctttttctgaatcaaaaggaacctttcctccatgagaagaatcctgccatatttctaggccaactgactgaaagggacaccagctttaaaaaataacacacacacaaattctgcttgtaatattagatgccccggtatcatggggacttccctgcccccttgtacatagatggtgggatggggtcagtgcaagcctagaggtgcctctgaagttaaccaattactggtttcagatgaatcctgatggtgcccccactttgtttggtgttgtattattttttttaaaggttgctttcagatagtggataggaactgggttatatttaagctggagaccactgcaggctttcgagcagaaaagggccatgctttgttttttttatttatttatttatttatttatttatttatttatttatttagatggagtctcactctgtcacccagcctggagtgctgtggcacaagctcggctcactgcagcctcctcctcccaggttcaagcaattctcctgcctcagcctccccagtagctgggatcacaggtgcctgccaccaccctggctttttttttttttttttttgtatttttagtagagatgggctttcaccatattgggcaggctggtcacgaactcctgacctcaagtgatcttcctacctcggcctcccaaagtgctgagattacaggtgtgagccactgcacctggcccctgctttgttttagattttacaaagctctctctggttgctgtgtgctgaatacaccctagaggacaaggaagtcgtcactagttagaaggctgttagatgctgtaggtgagagatgatgatggcttccacccggttggacatgattgaggtggtaaaaagtggtcagattatgggtgtatttgaaggcagaaatgatcgtttcttctggtagattggatgtggtgtttgagaaaaagggagtcatggatgacttcaggatatttggcctgagtgactgcaaatgtgaaattgacatattctgagatgaagaagaatgcaggtggagcaggtttgagttgggaggagagcaggaatcctgtttgggaatgtgttgaaagtgtgtattagatgtccaagtagaggcgaaagaagcagttgatgtccgaggttgcaatgcaccagtgctggggcgcggtggggatgtaaagcaggaagcactggaagtgacagcttaatgatcaactcccccacatcccacatagttatcaggaaaaggaaaatgagggggaaatcacatgttaaatcagaaaggagtggtcgggtgcagtggctcatgcctgtaatcctagtactttgagaggccgaagcaggtggatcacctgaggtcaggagttcaagaccagcctggccaacatggtgaaaccctgtctctactaaaccctgtctctactaaaaaatacaaaaattagccaggtgtggtggtgggtacctgtaatcccagctactcggaaggctgaggcagggagaagcacttgaacctgggaggtgaaggttgcagtgagctgagatggtgccattgcactccacctctccagcctgggtgacagagtgagactccatctcacaaaaacaaacaaataaacaacaacaaaaaaaaccaaaacaaaaaaaatggagcttcagagattatcctgcagaagggggaaagaggcccaaagactgcaagttagtaacaaagccaagacagagccagttccttgggcctgtccccctttctagcacaccatgctgcctgccagttctaggctctgaaagctgcatacggggactgaaggtgggcagactgaggctggatgacttaattttgtattcctccaggtcaccatccttgtcagcctggccctagctttccttgcgtgcatcgtgttcctggtggtttacaaagccttcacctatgatcacagctgcccagagggattcgtctataaggtaagaggtggttgagtagtcccaggtcactatcaaattcagttagagggttgatcaatgtcttctcttcactggtgtccaaattctgggtatgacgacctctctaccgactgtttaaaatggaatatgtgtttggcaaggagtttccaagttttcttgagggactcagtctccagtaagcagtagagttcctcccccaagatggtgctctccagggtcaggaggtggtccagcttggacggcacatcagcaatgagggaagcagctcactacctcttgacatggactgttccattttgggaaagctcggcttggtgcgggtcttcctggctcaatggctgtttgcttacccttgcagtggccttccagaggtgtgaaggtagggctggtgcctctgaggttctttgaagctctgtctccaagtctccccttgacccacactctgattaaactccttctctgaaagaacggaacctgctgcatgacctctgggagttttcttgcccctctgaacctcgttttcttgcctgcaaaatgggggctcataatgccttttcccaggatttttgggaggccttaaggagagaatttaagtaaaatcagttaacaaagggcctattagataatgaactctcaacaaatgttagttgcaataaagacagagtctgtttcagagtgaacacagctgataatatttataattaccatttgctgagtatctctaatacatcagaccctttgctagatgtttccttaaacattatctcaattgagctgtacaaccattctgagaaatagggtttctttggctcccatttcacatatgaggaattaaatgtagagagtgtttagttaagaaggttgtccaagacatcacaataattatgttttgatgtggggagatcaaataggaagtgtgccagcctgaaaatgtgtatacttcggttctgcactgcctagattacactccaatctgaccgcctctagctggttgactcacctatcacctggttgcctctctgggccactgctcacagccaatgactgtttatttcctccattatatacttgcatctcttttctcttatatcaaaagtcttggctcctaacaacgttcacgtaatgatgtatttgccttatcctacaatatacatagaacagtcacaaaatagcaccaatgttactactaagaggtaatgaacctggagactactgaacgaacgtggaggtttctccgcaactccatgtgtccttagaatacactccaccaagggtataatctgacttcctagacttccatggagggggttcagatctgccttcctagattacactccaagtggtcagaagctgaggttctgagaccatcctgaccaacgtggagaaaccccgtctctactaaaaatacaaaattagccaggcgtggtggctcatgcctgtaatcccagctacttgggaggctgaggcaggagaatcactttaacctgggaagtggaggttgtagtgagccgaggccgcgccattgcactccagcctggggggacagagcgagactctgtctcaaaaaaaaagaagctgaggttctggaagactcaaaacaatgggaacagtaggggacagttgaataaactgtgacacatccacccagtggacgtcactacaactgggaaaatgaggaaggcaggcctccatacacggaaagagaatgctcattaagacagtaaggatgagtgatggaaggaaggtcctgcctatgtgtgggcaaaggggaggagagtgctatttgcttattgttttggaaagaaattcaggaaggatacattttaaaaattaataaaaatggttcatcaggaggaagggatggacgcaaggcttcttcggatctatcttcttaaatatttgtccttgaaatatgtaaatgtttgacatatttaaaaataaatacatgagaaaaaacaagaggttcgttgtttaaagaacctagctctatatcaagttaaggacataaacgtgcaaagaaaataaatatttcaaccggttgtagatgacagcatgttcgcctcacacctttggtggagtgtattctagggacacatggagttgcagagaaacctccaagttcgtccggtagtccccaggttcattgcctcttagtagtcatattggtgctattttgtgactgttctatgtttattgtaggataatgcaaatacatcattacatgaatgttgttaggaatgaagcctttttttttttttttttttttttttttttgcgacggagtctcactctgtcgcccacgctggagtgcagtggtgccatctcggctcactgcaatctctgcctcctgggttcaagcgattcttctgcctcagcctcctgagtagctgggattacaggtgtgcaccaccatgcccagctattttttgtatttttagtagagatggggtttcactctgttggtcaggctggtgttgaactcctgacctcatgatctgcctgcctcagcctcccaaagtgctggaattacaggcgtgagccaccgcatccggcaagacttttgatataagagaaaagagatgcaagtataaaatacaggaaataaatagtcattggctgtgaacaacagcccagagaggcaacaaggggacaggtgaatcagccagatagagggagtctgtgggggtctctacagcatccactacagccggacagtcagtatgcagagaaggctggccttgaatcagtgtcaatatcaggttcaggtcgtctggcttcttctaagtggagctttgctgtttgtgctggtgctggtgttgggaaggctgctgcgtgccaggcccaggtcaggagctgtcacctgccctctggctgacagcccgatgcagctgcactccagtcagggtggctgtgttgctgggcaggttgggagcagtttgctgaatgacccctgactctgtctctttcttccccagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagagtcttga

SEQ ID NO: 37 - DNA, 3098 bp, Homo sapiens
ctgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggc

SEQ ID NO: 38 - DNA, 171516 bp, Homo sapiens
gcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctccccaccgtcttcccggtgtcggcccggggctgggcatcacgcttctgctcttacagagctgacagcctgcaggggagacacggagacagacacgtaaacaaacagtgctagacacacctccacgcacagaggatgacaaataacacagtgggggcgtcagggagagcttcccggaggaggagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattagaagattctcttcttctagccccagttccaggctgaaaggcactgctgtcccctcactcacactctttccatatggaaactgggtgatgctgtttctagctgggggcactgggtggacagtggtgctattcaaggtgttaaggagccctggaggagaggctattcaggtgagggtggagatgatggattcaccactgaacccagggactttgaggggtctttgggacattcacatgtcactggcctgggttggggtgcatatcctgacctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtctttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgtatgatgactcagggaatttagaagctatgtttctgttataaaaatgattgtggcaatggtttcacaactctgtgaatatgctgaaaaccactgaattgtacactttaagagaattgtatggtatgtgaaatatatctcaataaagtgatacgaatatgtctctgtgtctctgggtgtgtgtgtatgtatacatctcagtgctgaaattcttaagtaagttaagcatttcagagtaagacaaagatgataaagtggaccttttacagagaagggatccaggaccatggcaaactgagatagttttctgaaagataagcgaggtaaaattagctataacccggttaactgttccttttttcctgataccttccctatctctgggaaaaaacccctactttacagagaatgaagactcgtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaatttttttttttctattatactctaagttttagggtacatgtgcacattgtgcaggttagttacatatgtatacatgtgccatgctggtgcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatggtgagcatttcttcatgtgttttttggctgcataaatgtcttcttttgagaagtgtctgttcatgtccttcgcccactttttgatggggttctttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctagattttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttgctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtttgcaaacagggacaatttgacttcctcttttcctaattgaataccctttatttccttctcctgcctgattgccctggccagaacttccaacactatgttgaataggagcggtgagagagggcatccctgtcttttgccagttttcaaagggaatgcttccagtttttgcccattcagtatgatattggctgtgggtttgtcatagatagctcttattattttgaaatacgtcccatcaatacctaatttattgagagtttttagcatgaaggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagagcctgttattggtctattcagagattcaacttcttcctggtttagtcttgggagagtgtatgtgtcgaggaatgtatccatttcttctagattttctgatttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcctgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcccggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgagatgtcagtgtgcccctgatggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcccccctcccccagcctcgttgccaccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattccggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcagaacccaaatttttcaagtgcatagttaaatattttttctcttgacaagatttttttgatagagctgtttactcttctggtagagatgtagcttgagctattataaataaatacaaatagcatagatatggcattgtggtttcttgttaaacgtggtacctcaccaataaaaatatagcttacaatatttacatttgtgttaccactcactgatttgtatttgtatgcttatttcatagtaatttttcttgacagcatttattgttgaagaaggaagttcagggcacacctatgtgtgttctgacctggaaagtactaatagtcatattctttccatttctggaccttcttgtcttccagggtccttgttctgcatcccataaaagtccagggaccagtttcatctcttctcctcctctccttctctcccaagactaaccatctactgatgacacttgtgggctccatgttaaatttacttctttatgccttttaacttctgtcatgtgactcagcaacacatgccagaggttaaaggacactgcttgtagggcagaaagaaggggagcctctaacacagtgcttttttacaacttttccccctttctcttttaatgcattagccagaaaaatgataaggggtcatgaggggcctggacgtattccctgtaatcactgactatacaggctggccatttaggggtaaatgcttcagagaaggatattctttgtaaatcatgagattctctagggaggcaatgaatgtctcttgtttcactatctcattagagagaaagataaaatgcactttgcacaatccataatgatttatttttttctcttagacgcatcagaaaatatattaaagctaaaacattcttgctccttttcacatagattgcttgataaactaattgataaatccttttttttaaagtcagggtgtgaagatagatgtttaaaatggattgattttgattttttaaaatatcttaaggatataatacaatccatatatttcttaccactgaggactttttgttctataaagtaaatgtaactcatggtatcacttggaatttgatttaaaaatgcatttgaaagcagggatttttttccctattgctttagtttaatttttcagctttattaacaaacggaatgtaaattaatttcccaaagttaagtgtgtgtgtgggtatctcatgtgtatttggggaagctattactggcatgctttgcccagaagatagaactgtcagtaaacaactgacacactgttcggctaaatagtgaacatattctggagaatctttagcagcaaaatgtggacagttagattttgcttttcaacagaaacctgggaaagtgttgagctgaggggagagtctgagagaagtactattgatgagatcagggaggcattgtttccagttctaactattctagttctttgaaatgctttcccaatgggaattccttcccaatttccagggtcatcccaatgtttttaccacacacagcaccagcagccagtggccttcctgagccaggtgttgttccttctgacttccaaatccagtggataatggtgtcttttccccgtccctggctacatcttcctcagacagtaatgctactaagtactttgcctgttcaaatcatccatccgtggtagaggctgctgatatttcaggctggataacttgagtcctccctagtgaatctgatatccgagtcaaatcttctcatccttgtccacctttctttcttctgggccacaaatcaaaactctggagggtcttgtgagctcatatgtagtgcttcagtgcttctccagtgcaacagtggaagacacacctggctagtcacaccattgtgcttccaatcccatctcctctcattttctcagggactttgctcttgttgccatctcttctctgcactattgtttcttctctcctggataaatttcactgtaggacaaagaagggtgtattagtcagggttctctagagggataggactaataggttagatgtatatatgaaagggagtttattaaggagtattgactcacacgatcacaaggtgaagtcccacaataggttatctgcaagctgaggagcaaggaagccagactgagtccccaaacctcaaaagtagggaagctgacagtgcagccttcagtctgggccgaaggcccgagagcccctggcaaaccactggtttaagtccaagagtccaaaagctgaagaacttggagtccaatgttcgagggcaggaagcatccagcacgggagaaagatgaaggccaggagactcggccagtctagtctttccacattcttctgcctggtttattctagctgcgctgtcggctgattagatggtgtccacccagattgagggtgggtctgcctctcccagtccactggctcaaatgttaatctcctttagcaacacccttacagacacacccagaaacagtactttgcattcttcaatccaatcaagttgacactcaacgttagccatcacactagggtttaagaaaatgatggcaggtctaagcgagtcatggagggtttatgaaagatgggtcttggaaagggagttttgtgtataattgggttggctgggattccggaaaggaatttcagaatttagccctggtttcagggatacactgatgcaggaccagagcaacaagattttctcagaatattgatctacgcctagtaaaaacttgcaagaggatttgattttaattctgaaatcgatttctttatactttcaaccttcttctgaactacagctttttcatgttatacagtttctgcctaatttcaaattgaaagtgctgccttcttcatttaaaatgataatttcatttcttgagatagagttttgctcttaaagctttccagagtcatatctcaagagttcagctttttgccacgtctcacgacatacaatttgcaggtcatgcatcattgccttctgctcttcttccttctctccttgaaaaggtacattttctttttaactggagtggtgactctcactctcaactttttcatcagttcctgtggctgtttcccccccacccccagttctcaccctgttattgtgaccttccctttcccctttccctttccctctcccctcccctcccgtcccctcccctccctccctccctccctccctccctccctgcctccctccctcccttccttccttccttccttccttccttgcttccttccttccttccttccttgacagggtcttgctgtgtcacccaggctggagtgcagtcatgtgttcatagctcactgcagccttgacctcctgggctcaaaggatcctctcactttagtgtcctaagtagctgagattaaagacggatgctgccacacctggctttggcttttcttgatgtgtctaaattgttccatgtaaccaggcaatttcatgtgtctttaatttttctaaaagccatgcattccactgctcaaggtactggtttccttgtttacattattcttctataatgtggtatatactcatgaccttcgacacatacttttccagtgtctaattgaattcaaatactgtttcatcaggttcgacttacagtttatctaaatgagattcccaaaggaagaagtactcataccgtaggaggtttttctttgccttttcagtaaatggcctgggaaacagaactttcatgttttattaagaatttatggtgctttgtgctgtctttattagctttttgattatttagaaaaactgcatcatctttaataagtgatgttcatctttaaaaaattatatgtgtgcggatgtgtttatatgaatattctaaaaactacgtaaactgtataagagtctgatggtcttggtatgatgctgtaaatcatgattctggttgttatcttaaaatacggtacacaggccgggtgcggtggcttacacctgtaatcccagcactttgggaggccgtggcaggcagatcccgaggtcaggagatcgagaccagccagaccaacatggtgaaaccccgtctctactaaaatacagaaaattagctgggcgtggtggcgggcacctgtattcccagctactcaggaggctgaggcaggagaatggtgtgaacccgggaggcggagcttgtagtgagccgagatcacgccactgcacttcagcctgggcgacagagcgagactccatctcaaaaaaaaaaaaaagtactgtacacaatagaagtaactaaatttccttgttaattgtttgttacaatgaattctcatcaaatttttaaccacagctattctaaatttttgtcatccacagttttgatttttctcataaagtcatctgcagtcagattcatggaaaagactctaataagtagccttgaatacatgtttctgataacttaaaaatcaatggattaagtacaaatttccaaaagtctaattaaaataactgacatattcatgaaactgctaaccaagatcaaacagagcaacagttaattacatgggactaaactgataatggattataatttttatgacttttatttaaaatattgctaattctttaatattttattttccagatttaaggaaacttttttcttaaggtacctatagcaatttggttatgtatactcttgtgaataatattaaaatgtttgctttttctccctatcttatctctctaaaattaaaaaaaactattcgtgagtattttttattttatgacaatgtatttacataattttgataaaaatttattttttaaataacaagatacaatttaaaatgttaattatattagcaaggtttgacttagacatcatatttaaaaattcttgtaggtacttcggatacaatctgaagcccaccttgatttggccttcttgcttcagaagttaaaaaaaaaagttcaatctgagattcaatcactattctcactgtacttatgtaaatactcaggacaaatctgataaaactaacttattttacatacaaattagtcttgctctgagtactttggtaaaattgggatgacagtgatataccctttattagattgtagtcttgtgagttgttttcaggttttattatatacttgtagaagggactggatcttaaattcttctaggttcctctaatccaattttctcctatggaatttttaaatagaattactaacaatggaaaccattcttttctaaagcgctgtaagctaaaactaaacatcttaatataaattacaagggacaagccttgtgcctgatatgtgggccacacagaaagttcaccaaaccgcctgatgccatagtcagaggcattcagactgcaaaactgctgacttcacactgtggacagtgtttcccaaggccgttggaacaagacatcataatgagattcttaccccttgtaatgcctcccttcttcacttgacaggataatgccataattaaaatttcacaatcagtaacaattatgagtaacttaacaaaagctgatctaagaaatcccttagtccacttattgagtagctttggcaatatccctaacaactttttgttcatattgtactagtgggcccttttacagagttagcactgtctgctttaatttaacccagtcatggaatactacccaatggctatgccaagtcttacccagtttctccatggtcttttgatttgtttagttgattgcccttaggcttggcagaactattgcataaactagatttgtcatactcctgttgtttttactttgtattttccttttaaaaatatgtacctgatgtctgtcaaatttctgcagaaatgcaacttctaatagagtaatgtttgtctagtgtcttaaaatgatagccaacatcaatggaacagacaaaaatcaaacttgatgacatccagacaaacaaagcctgagagcttctccttatggccttcttgttgctcaaatgtggctaaaatggcttgatactgacttccagctgataatcacctgcccctgatgttgtataagaatatctatccaggacaggtccatcctagcacccagggatattcaaaacctgaatacaggctgatcaatctttctccaaagaaagatcttgattaaaagggggaaacgtgaaagttgcagatatgaggataaagtcagttctgtcagactcaaatttgagtcagggaagcatgaaggggaagggctcatgcttgcatatccgagataaggctatctcaaggactttctaaaataactccacaagaaattccttcacagctttcacatatctcattcttttcatgacttaacgttctgcacatatgcatacatttctaggaccaggtttatcattagacattctttagaactgtagcaattcagataagatgctcttgaaagaacccttgcctagtaatggcatctccaccaatgaactgacgctgactctggctttgagcttctggaaaaaatgaactctttccaagcagcttacatgagcttatcctttttgtcaataaaagcttcctcttaccatctcctctttgggtgtatctgtggctttactatagctgtgctatggtgagattacattatagtaaggttatattatagtctgggcagattataatatagtataatttgtgcccagattatagttctttttacttactcttggaaaaatacattaaattaggagataattttctctgatgtcttttttagcttgatgccatcagcatgcagacatcctctctagtatctcctgtcttgaaaaaggaaaggaggaaaacctcctttgatcttaggtccctcttcacccctgtcctatttaaatatttgaggaagttatttgttgtcccatgtctgctttctttctttctttttttttttttttttttgagacagagtcttgctctgtcacccaggctggagtgcagtggcacgatattggctcactgcaacctctgcctcccgggttcaagcgattctccagcctcagcctccctagtagttgagactacagttgtgcgccactggctaattttgtatttttagtagagatggggtttcaccatgttggccaggctggtctcaaactcctgacctcaggtgatccgcccgcctcggcctcccaaagtgctgggattacaggcctgagccaccgcgccaggccctctgctttcttatctattgtcttctcaacctattcaaattggctttcttttcttgtgctctgagaccatgcttgcctaggtcttgagtgacctccacattgtcaaatctcatggtcacttctccatctgagctctcaacagcatttgacccagtggactattctctgcttacaacaccttctgtacttgctcagatttcctctggaatcactagctgttccttcaggtgtcttttaatgggtccttctcatgcccttgactgtaaatcctggaataccccaggccctggcttgggtactttctcttttctaactttgcatgctcccaaggtagcttcctcagctgcagatttacacaaaatctatacattgatttctctctaaattatatttctagcccagatgcttctcctggatacagacacacaaatctaagtgcctgcatcacctctctccttggatatttaaaaaatctcaaatttaagatgttcaaatgtgaactcttaattatctctaccccaaactgtttttctacttgtgatctcttaagcaaaacaaaacaaaccaaagtaaaacaaaaaccaggactcatccttgacatttctttcccttattcccaattcatcagcaagcctttcctcttggttctactttcaaaatacaaccgtttgcttttctccatctctgctactatcaccttggtcctggccatcatttcttgcccccatgattgtagtagcctcctaaccaatttccagaccagctacaattcatttgcccacaatggccaggatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacagcaataaaaacagctcatgtgggaaaaaaaaaagaactttaggaggccaaggagggcgaatcacctgaggtcaggagttggagaccagcctggccaacgtggtgaaaccccgtctctactaaacataaaaaaattagctgggcatggtggtgtgtgtctgtaatctcagctactctagaggctgaggtaggagactgtcttgaacccaggaggcagaggttgcagtgagccaagattgcaccactgcactccagcctgggtgacagagcaagactctgtctcaaaataaataaataaataaaaaagtaaaaaataaaaacatgtatctcagaccatgtcattcttctgcttgcatgtcttcagtggcttccagttgaatttaaaataaaacctaagcttcctcttcgggcctgtgaaacctcacttgacttggcctctcccactcctctcctgaggatgtttagccgctttttgctcccttggtattctaagaaaggtcattctatcttggggcctttgtggtagctgttcccttagcctagcatgcttttccccttgatccttgcaaagtagttccttcttgtcattcacatcatagcacagattaaggtctccttttaagagagggcttccctggctattcaattcaaatagacatttaccctttcttgtctgttatccagttgggtggattattttttcctatcacaaatattttaatattttcgatattttgataattgtttttcaatataattgtgttcctttattctatgtgcttttaattaaacattttattttgaggtaattgcagattcacatgcaattataagaaataataccaatctcttgtatcctttattcagtttcccccagtgataacactatgaaaaactattgtacatatcacaactaggatgtttatgttgatacagtcaggatatagaacaggtccactaccacaaagatcccctgtgtcaccctttatagccatacccacttccttcctgcctccattccctccttaacccctggcaactactatttttttcttcatttctataattttgtcattgcaggaatattatataaatggaatcatacagtctgtgaccttttctgaatggcttaaagtgtcagcgtaatactatattcacccaggttgttgtgtatatcaatagtttgttcctttttattgctgagtagtaatccatggtatggatgtatcacagtttgttcaaccattaacatgtggaaggactttgggattgcttccagtttggggttattatgaataaagctgctataaatatttatgcacagattttcctgtgaatgtaagtgtgtgtttctctggcgtaaatgtccaggagtgcaattgttagaatatatatatatatatggggaaaggcatgctaggctaagggaacagcaatcacaaaggccccaagatggaaacacccacccaactggagatatatgtatataaaatctaacattgtactcctggacatttatcccagaggaaaggtactactttgcaggtatcaaggggaaaggcatgctacgctgaatctgtttaggtttttaagaaactatcaacctcttttccagagtggctgtaccatattacattcccaagagttatgtgtgacagtttcaatttctccacatcctctccaccatttattgtcattctttttaattttagcctttctgttagatgtggagggatatgtcattgtggttttaatttgcgtttccctaattgcttgtgatgttgaatagctttgcatatgcttattggctttaagtatctcctcttatggaaaatgtctgttcatatctttagcctgttttctaattgggtttttaaaaaactgttgagttgtgaattctttatatattatagatattagtcctctgttggatatgtgtttgcaaatgttttctaccagtttgtagcttgtcttttcatcctcttgaatcagatcttttacagagcaaaagttttacattttgatgaagtccaatttaagaatttctccacatatggatcatacttttggagtctaagaactcttgcttagtcagagatcatgaagattttctcctatgtctatttctgaaagttatatagttttatgttttacattttagtctgtaatccattttgaattaatttttttaataaagtgtgagacttaggttgttttctttgcctgtggatgtctacttactccagtaccacgtgttgcaaaggctatccctcctccgttgaattgcttttgcatctttgtcaaaatcaactgagcatatttgtgtgggtctactcatgccttgcctattctgttccattgacctgtatatctgtcccttggccagtactatccagtcttgatgactgtagctatattctaagtcttgtatcaggtagactgacttgtcccacattattctttttcagaattgttttagctattctagttattttgtcttttcgtataaattttagaatactcttgtctatataaaaaaatcttgctggagttttgataggaattgcgttaaacctgtatatccatttggaaagcattgatgaacattgatatgtttcctgttgtaagtcttctaatcaatggatatggtgtatctctgtgtgtattttgctctttgatttctctcatcagcattttgtagttgtcagcacatagatcgtgtgcatgttttattaaatttgtagctaagtattcatgccttttttttagtgattgtaaaaggtattgtattttcttttctttttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttctgttatatttttagtagagacagggtttcaccatgttagccaggatggtctcgatctcctgaccttgtgatctgcccgccttggcctcccaaagtgctgggattacaggcatgagccactgcgccctgccaggtattgtatattcaatgtaggtgtccatgtatttattgctagtgtatgaagatataattgtttttgtacgtttatcttgtatcctgtgaccttgcagaacttatttattagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtgagttttattagtttgtgtttttcaaggaattggttcatttcaattaagtgatcagttttaggcatgagagttatttatagtattcccttattattgttttgttgtctgcagggctatagtaatatctcatctttcattcctgataatggtaatttttgtcttctctttttctttttcagtcctggtaaaggtttgtcagttttattgatcttttcaaagaactagccctttgttttattttctcaattgttttgttcttttcaatttcgttgatttctgcccttatccttattattttcttccttctgcttccttagtttatttgcatattttccttccacaccaggttcttgagggaaatgagattattgatttgagaccttttctgtcttctaaggtacaaagttagtgctatattctttccttttatctcacttcagttgtgcctcactaattgtgatatgttgtagtttaattttcattcaattcaatgtatttttgacttcccttcagactttttctttgatccatgtatcatttagaagtttgtttttttagtttccaagtgtttgggatttttcttgttattgatttctactttgatttcattgtcattatagaacactttctgtatgatttcagttcttttaaatttgttgaggtttatctgatggctcaggatatggtctatcttggtatatgttctgtgggtacattaaaacgatgtgtatctgctgttgttgagtggagtgttccaaataaattatctaaatattgattagctctttttggttgatagtgttactgagttcttctatatccttactgattttctgtctagttctattaattgttgagataagtctccaactataattatggatttgtctcccttctttcattgctaccagttttgctttacataatttgcagctctgctgtttggtgcctacacatttaggattgctatgtctacttggtgcactcactcttttactatcatataatgttcctgtctctgataattttctttcctctgaagtctactttatctgatattaatatagccagtcctactttctttttcttttctcctgttttctttggattaatgctcgcataatatatacattttttgactttcaacctgcctatattgctatatttgaagttttttgtttatttgtttttttgagatggagtctcactctgtcacccaggctggagcacagcggcgtgatctcagctcactgcaacctctgcctcctgggttcaagtgattctcctgcctcagcctcccaagtagctgggattacaggcatgcgccaccacgtctggctaatttttgtatttttagtagagatagggttttgccacgttggccaggggttggtctccaactcctgacctcaagttatctgcccaccttggcctctcaaagtgctgggattacagacatgagccactgagcctggcctgaagtttgttttttatagacagcatatagttaggttatgctttttaatctactctacctgtcttccttttaactggtgcatgtagaccacttacatttaatgtaattacttatatgttagcgctaaaggctgccattttattttgggggtatttgtttgttactctgtttttaatttattttcttttctttcctgtattcctgtgtgttaggtgaaattttttagtattccattttggtttatatagtgtttttgagtacacctctttgtactgcagttgtcgtggctgttcacatgtgtgtgtatacatacacacacacgttatcaaagtctactgatgtcatcattttaccagttcaagtgaagtgtagaaaactaacctccctttgtcttccattggccttccctatttataatataatttcattaaatatttcttctatatacatttagaaacacattagacagtattatagttgggctttaaccatcaaatatagtttagaatacttatggaaaggagtctattatgtttacccatatttttgcttatcatgtacttttttcttttctgatgttccaagattctgttttttattgtttcttttagtttagagaactttctttagcccttcttttagggttggtctgctggtaacaaattctcttagttttccttcatctgaggatatcttgatttctccttcatttctgaggatatttactttggatataagattctgggttgatggttcttttctttaagcaactgaaaaatattctgccactttctcctggcttttgtaaggttaaattaaataagcaggaggttattaccttgaggctgttttcattctttgagtttctacctaatgaaccacaaccaaacagtatgtaaacaaattaaaagctaacttagaactataacaaacagccaagtttcagccagtcacaggcagctagctgatcagactatgcccaaataaggcaaatacctcatcataccaggctttaataaagcagatgcctagctgtagccaatccagtgatttcatgactttgcttctgtgtctggcctataaaagttcacttctcatactaccggacacaggtctctgaacctcttctggttctgagtgctgcctgattcatgaattgccctttgctcaaataaacttgattaaatttgtctacagtgtttcatttaacagtgatttctggtgagaaatctgctgtaattcaaattgtttttctctataggttaagtgtcatttctctcactggtttcaagatattttttctttgtctttagattttagaagcttgactatgatgtgtcttggtgtggatttcttttcttttcttttttttttgagacagagtctcgctcttgtcactcaggctggagtgcagtggtgccatctcagctcactgcaacctctgcctctcaggttcaagtgattctcctgcctcagcctcctgagtagctgggattacaggtgcccaccaccacacctggctaatttttgtacttttagtagagatggggtttcgccatgttggccaggctcatctcgaactcctgacctcaggtgatccgcctgcctcagcctcccaaagtgctgggattacaggcgtgagccactgtgcccggctggatttcttgctttatcctgtttggcatttacttagcttcttggatctgtaggctgtcttttgccaaatttggaaagttttcaaccactgtttctttgagtgctttaccagtcctgccttcttttcccttctcttattggaacgctgatgacatgaatgttaggtcctttgttatggtccctcatgtccctgcagctttgttctttgtcttatttttttcctgcagtttattttctctctgttgttcagattgggtaattttcattgttctatcttccagttcacattttttttctctgtttctgcattctgtgggtgagatataggctaatttttaatttcagttattttatttttcagttctaaaatttccatttagctcttcttcatatgttccatttctttgctaagactttctatttttcactgcttctagcatcttcacagtggcttcttggcttctttagaatctttgtcagataattttaatggttctgtgatcttggtgttggcatctactgattgtcttttctcattcaactagaaatcttcctgggtcttggcatgattattgttttattaaaatctgggcatttggggctatgatattatgagactctggatcttaattacattgtctggttttgcttgttttctttgacattgctctggtaggggacatggggggcactgccttgttacttccaggtgggggaagtctcctctcagacttcactgacactcaaggtggggtctcattattgctgagggggagcgagagttccggccattaggcctccactgataacaaagcactcctacccttctctggttgggaggggtatgagtgccttgttactgctctgcacttggcctcaactgacaccatggcgggggcagcctcattaccaccaggtagttctgactctccactaggcatcctctgacatcaccccagtggggaggagcaagggcacctcatttctgctgatggaggcgaaagttcaggctccccacatgctgtccactaccaccaaaggtgggtgggggggtgggtgggtgttgttactgccttatgggtctacttggccttctctgacactgccccaggggtgaggaggggagagggctattggttacctcatttcagcctggcaagggtagaagtctaggcccccattcatcctttgctggtgtggataagggtacggccacattttgttttctctgtggtctgtggctggagtagagcagttattgtctaaaagttttctttcttccttggctgccccttgcttggtcccttggctagagagagcagacatttgcttggtcccttggctagagagagcagacatttgttggggcttttttttttttctgagacagagtctcgctctgtcgcccaggttggagtgcagtggcacgatcttggctcaccacaagctccgccttctgggttcacgccattctcctgcctcagcctcccgagtagctgggacgacaggcacccgccaccacgtccggctaattttttgtatttttagtagagacggggtttcaccgtgttagccaggatggtctcgatctcctgacctcgtgatctgcccgcctgggcctcccaaagtgctgggattacagacgtgagccaccgcgcccggcctgttggggcttttttttttttttatgtccatgcgcatttccgtgttgctggcttcttcagctccaaatcttggacacgtgagggaaaaagaaaactgagagaacccatgaccttgtcctttcttgggtcccagggtcccaagctggtgtgccttcttctctccacctttcagagtcttcttatgtttgtgttctatataatgcccggggttttaaattgtagttagtgtgaggaatagagaaaagtatatctaccccatcatccctgaagcagaagtcctctgtgctacccaattttaaatcccttcttagcggatgttactgtctgataatctcttgtcctgtttatccctatggtatcccaagtccctcaaacactgcctggcacatagtagttgtgtagtaattatatgctaaatgtcgaatgaacattcagcaggtagcgatgatggtgaattggggcctgaatgtcctgcttctgtttaccttcagcctgttctttgcctagatcctcttgatttttttggagggaggatgctaaaaatccagattttatatgaaatgtcctacttttgaaatattggcaattaatttaattttttaaaaagctgtgcaggccaaagaaatgtgtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccgttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcggggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaataaaataaaataaaaaataaaaagttaactagcattcctgaattttacccatcctggatctctgctattcacattggtgtcaccaagtgcattttccaagaaaagacagtcattgcctaaaacaaattgtcacctgttgtattgaaattattttggttacttcctgtgcctgtctaccagatactgcttatacaagtcttgaggaatgcttgctgagtgaatgaatgcttgcattcttttctcatgacttcgcacttacagcgcacagaaatctgaggtctgtagactcctggttgctgaagagttgggatgttgcaccaaaattaaaattttctttattgtattagtctttgactttaactctggcatctactttgtttggagctttgtcttttataaataaataattaggagtaaggatttctaaacattttatcttcatatccaggacaaatgttttgcagttagttaatcaaccattacgtgagtattgatcataatactaattagatttattttgcagatgtggtggatgctatacaaagtgttttagtggaaaggtctcatttaatcctcataactatcaaaaaatagtataaacagtcaaatagtatgtcaaatagtataactagcaaaaagtagattaaaatagtattatttttatcctccttctacgaaggagggaattgaggcttggcaaggtcaagtaaaatttgctgaagtttatacagttggaaagtgatcttcccaggactcaagagcaggcttgtgtgattccaaggcaagtacagtacagtatttgttaccatcgcatgagataaatatttgtgtttgtatttgtcaccattgcatgaaataaatctgttgctaattctctaaccttttctccatgattctgaatccttatataaatttgaggtgctttcatcattcattggagccagatgtcacctgtttacactctgtattacatagaatattctaaaacaggggttggcaaacatttggcctgtgggccagatatggcccactgcctgttttattgtacagcttgtgagctaagaatggtttttataatttcttctaatggttgaaaaaaatcaaaagaataaaaatatttaaaacatgtgataattacatgaaattcagatttcagtgttcatacataaagttctattggaacacagccatgctcatttacctacttgttgtctctggctgcttttgtattacaagggcagagttgagtagttgtaacaagagactgcatggagggcaaagcctgaaatactactatgtggtccctacaaagaagtttgccaacagtttttctggactataagtctgggcaattgaagtatggcggtatgcatgtttctgaagccctggatagaacactagaagcgttttgtctgaatatgcagtttggttgtgcatttttggaggatccccaatgctcaacagttctttttcatcctggtgacctggggagggcctcactctggaatacattcttactttgtagttcaggagctacaagtaccaaaaagtcacctctgctaatgccttacttggccatcacacaccaaactcttctatccagatattatagtactggggaagaatgactgtggtatgtttgcttggatggggactctcatttacttggagggaggaactcaagaagcatttttgggttgcaggttgtctggcattttgctgtgcatttcattgtaatttctcaccagggaaacactgcttgctctcctggctgggtttacttcatttctatcatcttttctttcttgttttaataattccaacttcatcttgccttctcctttgcttcattttgaaagagtcccagtttgcttttcttgccaattctctacttacttttcccagagctcaaaaattattcttgggggtgatgtcattttcatgtttatctttcttctctcacatgacttaatcaaataagtatgtagattataatttgtgagctgtgttctgagggaattaattgatcatcatcatattcttttaaaaggactgtggccagttttagcctcggttaacttcagtcagtttgtacaatagtaatggaatgttttggcgtctattggagcaggcgtggaccatatatgttctataggcttttcagaaattctatgcagaaattatgtgaaccagatggtacccttttgatttgccagacatgcatacttaaagaaatgtggggcatttattctccttaggagacttagagggggttctttgggaatgtaaatcagccaaaattgtcctaattgaaaaattctttggagtttgtcatcaaaataaggagtgtactatcagaagaccgcatagattttgcgggaacaaatattactggatttatttgatttacttctctgagaatgaaaagccccatagacttaggtaaaagaggatataatccatgagatgcttttattttgatagggccatggatttgctcacttaggcctctttggggacactttcagcagtgagagtatgtggatgtgaggtgggtgagggagatggcatgggtcccagggaatgaacagacagtgagggccagttcattaaaccgaaagctgaagggacagggtctagtcattctgagaagaccagactttaggggaacttgcagatcattgcaggggcttaacctacgggagggcaactgttagatttcctctgagcaggtagaaggtgtacatgagtcatagttacatctaagcacagagatttgggattcagcaaggattgcagaggaggagatagtgtctttcttcaggtaatatgaagagcacagtggaactggaagccccagccagatagggagagctgagtctggttggctgtctgcactggcacttgctggggactttggggaaatgtctttcagtgcttcagtttccttatctgcaaattggagttaatacctcaaagggctgatgggtttgtgccgcttacaaattatttggctcaattctaacttgtaatgttgtgctgaagcttagaaattatgtatctcaagtgctttatatatgatatatggtttaattaatgggagctttagtatagtaatcatttagtatactggttaagagttgagttcagaatcagagagacctggctggagtcgcagctcagccattttggtagctgtgtgatggtgaacgagtcacatatcctatgtaagcctcactctcctcttccgtatactagggtaaagagcagctccaacacggtggactcaactttggggattaaatgagctaatgcacatgaggtgctcagcacagggcttggcccataataaacgtgtaataaatgctagctgataactttctccactgacctcctgcctggaacagaaaatgaaattctgcttcttaaaaccaaatgttataagcttcatccttataaaccaactgcctttagaaatgtcctctttctactcttctctgggttcctggggagcagaacgcctgcttgggtgatgacttatgtctctcaaatcctctctacccctccatgatatcacacatttccgtcgtacggcatgtactaaggtctgcacttaatttatgatgtaagggccaggtgcgtattttcagccttcaaaggctgagtatatttgggattgactctgaagggggaatcccctgttgtttcattcatacagtaggtatagcctgatggttagagtgtgggttagtatatctgggctgcgtagcttgctttcttggttggcactccactgtaagcagacctcgatttgtgtagaggtagagcgtgtgcatgtgtgtgtgtgtgtgtgtggtgttgatgttgttgttcttgcagtgatcccgggaaaactagctggtgagtagggagagtgacggggaggagatggaagccaatcaaggtgcactattaatcaagttagttaccatggatggtaactggagctcattcttcctagggaactctcacagacagcatagaagccacctgagagttatcccagcaaaggcaggaagctgggggatttatctaccaactgccctgcccatcattggctgaggactgtttctgggacgttaagtccctggcacttccaatttgcctggcacatgggctaatgttcctttggttgggggtaaaaaggcctccagactgaaggttgcaggtgtttgtggtaacagacttgatcttgtagaattgagtcctcggggccatcagtggggcactgacagcatctgctctcctgtctaaggtggaaggctgtctctgccacctaccagctctgtgatcttggccacactacttattatgcctgagtttcctcatctgtaaaatgaagataataataatacctccttcccagacttgtgatgggaatgaattgaactgatatgtgtaaggcacttggtagaatgcttgccatgtcgtaattgctaaataaatgctaacttttattattttgtgattattcattgagtttcttcaggttctttttcagtgtaataaaattcaccatgtttactgtgacataagatgaagattttttggatggaaactaattagttgtttctttgggcatcagattatttccccaatttttatttatttgaaaactgttacaacaaaaacgcaatctgttttagggttaaaaaaatcctctttaactctatcacccttcaattattacttttatctttttgttcctttggagtctgttgatataaattcatatttctacactgttataataaataatggcaaaactcagtttttatcactgtttgttctaaaaataaaatagcaaccctgtacccagcatactttacaggttttttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcctcccctctgctctgtgtctctcacggtggctgaggtagaatacagcttggaagttcagccagcccttagtatccatgggttccacatttgtggagtcaaccaaaagaaggtcagaaaaatttgagaaaaacaccaaaacatctggattgaacatgtgcagactttttcttgtcatcattccctaaacaatacagaataacaactatttatttagcatttacattatattagctattataagtaatctggagacaatttaaagtgctgtatatgcaaaaatgtgcatagattatatgcaaatatgactccattttacatcagaggcttgaccattcaaggatttgtgtatcccatgggagtcctggaaccattcccccatggataccgaggggtagctgtacatttattggtgcctgccttcttgcctggtgcctgtttgttctttttggattaagagaaataattcctggctgtgcacggtggctcacacctgtaatcccagcactttgggaggccgaggcgggcggatcacctgaggttaggagttcgagaccaggctggccaacatggcgaaacttcctctctactgaaaatacaaaaattagcgggcgtggtggcagccacctatattcccagctagtcgggaggctgaagcaggagaatcgcttgaacccgggaggcggaggtttctgtgagccgagatcctgccactgcactccagcctgggggatagagagacattctgtctcaaaaaaaaaaaaaaaaaagagaaataattcctgtcacagggagcggaaacatgctgaaataattatttgctgaaattgttttccaacagatggctttaggaatcaggagatttgacactaggacgttaggtgggcaatggatttctagtaatttgtcagctttgttttattgaggtggagctgcatttaaattgctacttctccctgctggtttggtttggttctcctcagaaatggcttactttatttgtacttgacttgagttacattaaagcaggcaaaaatatttcttaagagctgaaatttcaggttggcaaaaggaaacaatgcaatctttaatcatatatctgaaagagcacagtggtgcattatgatggcagaacttcattccctaaccctgtacaaaggtttttagagactaaaggattgatcgtttttttcccctgacaaaacacctcttttgacatgtgcagagaaatatgtaatttgggttgcattgaaagaaagctactcttgctatttctctctccaagaggctgtgctcttggagttaatattttctactggagacagttctacttgaaaggcaaatattacaaaaaaccactagagaggcattgaaatctgttgtgggaaggagtcattttaaattttcttattaaaagaagatggcactaaagaggggggagtcatttccaatttattacttaacagaaagatgagcaatttgtcctctcagcaatagtgttctgtcagataacctgtttgccatttccttgccaacactgggtcttgccattcatttgaaatgtttgctcttgtgatctattaaaaaatttgtatatattgattttacatatgtgctgatcatttgcatttcttttgtgaattgccttttgatattttccatttttaaattgtcattttcaaatttacctttatatatgaaatatattaatccatcatcatatatcttgtaatggtttatttagctgatcctttgtggttgttgcaagcttttttgtgtattgttttacagtttgcagtttttgtcacaaattaaatccattttttgggatataaagtaggctttactttttatatattctgttcttttctataccggtggaaatcttgttattaatgtatactgcctccttagggtttgttttccaaatctcttttctttctacaagcatattagtctgttgagccttcttaagtttttttttttttgattcaaagtgtcgctcttgttgcccaggctggagtgcaatggcgtgatctcggctcactgcagcctccacctcccaggttcaagcgattctcctgcctcagcctccggagtagctgggattacaggcgcgcaccaccacacccggctaactttttgtatttttagtagaggcgagttttcatcatggccagggtggtcttgaactcctaacctcaggtgatccacccacctcagcttcccagagtgctggaattacaagcatgaggcaccgcgctcggctgagccttcttaagttttgagagaattttcttaagtttgttttctaagtctctcatttggtttcctttgatacgcaagctagtttttctatgctataccatttttaatgtgaacagttccgttctaggaatagaaatcttgatctcaatttgtccttcttccagggggcaatgccatcaagaatccaacctggaaatcagaatcagtgcactgttttgacttttccttcccttgccttctgtgagtttgtttcttatggtcatacttactttgatttctccaattggttctcttattttaaatgactgagtttcttcatatgttggattattttctcctatgctcttcaaagaaagtggctctagtgtgtctagtttcagcaggtgagatatagtctgttgtcagcccagacagggtgagaagggagagcttcagattgatagtttagctttctgaaaggaaggttgcaaatggagggccttgctctagaccagtgcggcccagtgcaaactttctgtgctgatggaaatgttcttggatctgagctgcctggtatgatagccactcaccatgcatgactactgagcatttgaaatgtggctagtgcaagtgagatggatttctaaacttttatttacttttaattaatttttattaattaattaaaacataaatttaaatgaccacatgtggccagtggctatgtattagatagcacggtcatcatgaggacggcttcctgtgtgatttgtttactgttgtgttcccagccccagtacttgtcacacagtagacactcaatattcatagaaattaatggatgcagcaaggggaaatctctggtagggcttctttccttgctatgccaagagttccttttctttctgtgggtctgcccaaagttagagaagtcgcattaccctcatcagtaactaccacaagtgctgttggtaggggcatctgtaggattcccatccccatggccctttttatgtcctactgtgtgtgccagtctgaccagtgagatcaatccatccttgccttaggaattcctaagaatttcagaaatttctcaaagctgctgccaggaagttgggagttgtcctagtttgtaaagctgatctagatacttctcagttttatagtcctatggccattccagggagaatgttggtgctagagagaaaagaactgagatctgtgttttgaatcaagagcctattgtcatctttctgtgttttaatggcttactatatcttgatgcaaaagcttcagtgtttacgaggctccactactgattgtatctttcagcaatctcaaatgaccctctttaatcccattttctgccttcttcttatactcagaatgatacaaatattacccccaatttaattttttcctcacatttgccctcatcttttggtgtaatactatggtgttactttaaagggtttttaagaagcaggtaatttatgtttgaaccaattttgattgtctttgcctattatttattgaggaaatcgtactattgacacagtggtatgtctggtcatctgccatttcgttttccttgttttttgctttcagtcctgtctttacattatcattacatttacttttatcttgtacttttgtttggatcatagttatgccatttctaattctagtagtggatcctattaagtttttaaaaaatccatattaaatctatatttatgaaattgctgaagtcagtaaaaatagttttttttttcactctccctgatagacaatcccacatttctttattttggttgtttttttgtatctcttttcttttcttctatttcctgagacatttggcaatctaatctagaactattcaagtcagcatttcacaaataacctcagtgattttcttttgtgtctctcttcataatcctgttatgaattatgcatgcatttatattaaacttagttgatgctcactttgccattttgagttcttaggttttccagctctctctgacatgaagcacattttcaaatacgttcttcaagaagcatacaccatatgttttctgagactttgcatatttaaaacattttttttggttgccttctgttgcgaacaacaatgtgtcttaatttagtagttttaaagtcacaagtgtttaaatattaaaatgtagatattgatgcattatcttccaaaacctcctgttgggggtaaatattgaggccatcctgatttgtattcccttgcagataatctctctgtctcctattttctcacctttgaattctgatgactctttatgtgtccttgagactaaaaaatgtcaccagaacatgtctatcagtgaatctctttccattaattttgcttaatatatgatgaaccatgcaaactgaaatctgttttcaactgaggaaagtgtttttttctggtaagtgcttatttattgtttggatactatttgtgtgggttttattttgggatgaaatagttttacatgggttggatgtttcttctgtgttccttcatatattaatgtaggtgcctcaacaagtctggggaagaataatgaaaaagtgttgtgttctttgcgatgatttttgtttttaggtaattttttgctccatttttgaagtatttctcctctttttccattggctgcattttttagcattgtaaagtgtgtgaagtttatttattcatttatttttttgaggtggggtcttgctctgttgcccaggctagagtacagcagcatgatcatggctccctgcagcatccaccttccaggctcaagcaatcctcctgcctcagcctcccaagtcgctggaactacaggcgtatgccaccacacctagctagtttggtttttgttggcattttttttttatagagtcagggtctccctatgttgtccaggctggtctcgaactcctgggctcaagccatcctcccgccttggcctcccagagtgctgagattacaggcatgagccaccatgcctggccggaagtttactttttactgcctaccatgtggatttgtttttttaaatttctattatgaggaattttatacatacagaaaactaaagagaaaaatactatgaatacctctaccccatcacatagattaacaggtattaacattttgccatctttggtttatcttgttttattcctgaagcattttaacagaccacgtaacatttcattcccaatacttcagtatgcacatctgaaaaataagggcctttctcttaggcctttctctaaccatgctaccactatcacatctaacaatgattttttatgtcctccaatgcccagcctatattcaaatttctctaatattctccaaatgtcttttatggccagcctgtatgaatctggatctaaccaaagaccatacattgtatttgatagttatgtctcttatactgcttttttttaaattcaaatttacataacataaagttagccattttaagatgaataattcagtggcatttagtagtcacagtgttgtacaatgatcatctctatctagttccaaaacattttcatcaccccaaagtaaaacctcataccctttaagcagttactcctcatttcccaccccacccatctcctgggaatcactaattatcctctgcctctgtggatttacttattctggatattttatatgaatggaattgtacaatatgtgaccttttgtgttttgcttcttttacttagcacagtgtttttgatattcatccatattgtagcatgtatcagtactttattccttttcatggctgtataatattccattgtataaatataccataatttgtctattcatttatcctttgtggacatttgggtttttctcccttttggttattgggaatagtgttgcaatgaatacttaccctagtcagctcagactgctataacaaaatactggaaactgggtggcttaaataacagatgtttatttttcagttatggaggctgggaagtccaagatcaaggcactggaaaatttggctcttggaaagggcccgcttcctggcttgcagatggctaccttctccctgtgtcttcacatggcagagagagagagagagagcactctggcctctcttcctcttctttataagcacaccggccccatcatggggtccctacacttgtccctcttctaaacctgataacctccccaaagccctgcttccaaatacaaccacattaggagttagagcttcaacaaatgaatttgggaggacataaacattcagtccatacaatactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaattttcttttctttttcttttctttttttttttttcctgagacggagtcttgctctgtcgcctggctggagtgcagtggcgcgatctcagctcactgcaaccttcgcctcctgggttcaagtgattcccctgcctcagcctcccgagtagctgggattacaggcacatgccaccaagcccgtctaatttttttttgtattttagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggtgaggaggttgcatgcctcagaatgcagttagcctgggcatctgtgcaccaggctgagttcttgcctaggagctgcagatgtgtgatgaatgcagaactaaagttattgaggagaccaagagacttgacctgggagtgcttatgtggtttggatgggattccttgaggcttttgtggaggagcagtccgtggagtcagggtgtccgtgggtcactgttagcccacatggtgctctttgtatgagttagaaaaatacgcctcttcctcgacacactttactttcatgcgggggaaaactctcctatcctgaattggttagagctggtgatttgacagccgcctgctggaaaattgtatgataagtacacaaatctgcttcaggagggtgtgctcccttccatgtggcacagttgtcaccccctgcccagctgcctctgcagccactttgggttttgtggctgatgttcactagccactgactatacatctgaatctcttcctgtcagtagaagatccttctgatttgggcatatggtcaactttttatttttcataactcttgctacccctttcctccatttttattagttttcatggggacttaagtgagcatccaggcaccgttgctgatctgtctccctgacccagaagaccatgttggcttttggacaaagatcctggatagttctgaagctatgatgctgtgcatcagggttgaatgggggtcctgagagtccagcattgcttgtgctagcagctcatagcagcttaacttgtgtagcagaatgggtgccttgtaatagatagccatctgcttttcagtttatggaaggcttcgtttcttctgacggcattctgacgggcaggtgttacatcttttgtgactcccaggttatgaggctggttcttgggtttgactctgggaatcatgctcattgatctgcttttcctaatcatgtcagtgaatacctacacgtgaagaaaactcaagctgcaccataaagctaaaggaagaaggtaaaaaccacctcaaatttccgtgatacaggaaaaactgctgtgaccctccacttctccatcctggtcccatttcctgtttccaccctcatccagtttgcttttccagaatctttactgcttcctttgatgggggtaacgactctccctaaccaccccacctcccgtgggaactgttaccccatccatagccagcatttgacagcccaagggcaggtttatgtatttgcaaacgacattattctcctataactaaaaatgtaaagatcctttcgtattaaatagtccagtgtccctagggcacagtgcttttggatttcagcctgcttctgctttgtgatcttgggaaagtcactaacccctctgggcctctatctctatttaaaaggaagaggctgaaccaaaatgccctttccaggtgaaagcaagtggggaagttagacctatttagggaatagagaacagcctgtgggacaggtttgtgcttattgttggtgcagtttagtaggaattgtcagaagccgatagatagatagatagatagatagatagatagatagatagatagatagataatagatagatagataatagatagatgattgatagatgatagatagatgacagatagatgatagattataaattgatgtttgatagatcaatagatagataaaagggaaccaaatactgtctctgtggcctgggcatttttgccaggcagggggaatcacatcgttggtgacagagttgtatggcccacagaggccagctaagagattgggagaaggttgttgaccttgtgtgggaaccaacctcagggggatggatgaggttggggccccttaggggtctccgctcttggcgtctggactccccttctctgtgggtctaagctggcttctttctgctgtgggattgtgttaacactgcccctttagtgattttgcgttttttttttttttttttccgctgaccctcattagcagaggttttgctcttacacactgcattgtcccagtgacttcttatatgccagtcactggtgggtaaatgccagagggacactgagggctcatcaggaggactcagcctcctctcagagaggaagccaaggtggccagattacaatttgttttttctggtaaatgtcatgggtaggaaatgttatttgtgagtctgaaatatccaccaagggcagagggtgctctgaagacaaacaggaattgagtgctcattttcttggccctgaagtgatgtgttgcctccgtgatgtcacagttggcccccctacaacctagttcagcctggcacagtatatgacggtggtcactggctttctatctgggcaggatagcacctgcacatcagggaaaacagaccaagctctcacaagggcaatatcatcctttggaatttgttcacttttaattacaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacaggtaataaatgggaaaatgttaagggggagtggttggggaagaacagtaaacttggaaaagccattctcatcagcacagaagcactgaaagaaggtacagatcttcatggtgaaaagtgggaagccttgtattagcaaggagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggagatcaagaccatcctggccaacatggtgaaaccccgtctctactaaaaatacaaaaattagctgggtgtggtggcatgcgcctgtaatcccagctactcgggaggctgaggcaggagaattgcttgaacctgggaatcggaggttgcagtgagccaagatcgccactgtactgcagcctggtgacagagcaagactccctctcaaaaaaaaaaaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctcccagttaaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttaaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaattaaatgatcctcttcccagccatgttaccgtgacacatcggctctgtcttggggatcagtggctcagcaagtgagtccttagtgtctcagttcatggccctcctccatgctggtggccttcacctcctccattgcatccatccatcccgtagccagactggagcctttggcatcacccagacctgcttttacctgagttcttaaattccatcctgtgagctcctgccctgagcgattcctctggttctattgcagcaactttccaatctgtaacccgccatgcaatcataacccacgtggtctcgactgttaagtaccagaactgctgggcgggagggagggtgagcctggagacagaggtcaggccaggttgtgggccttctcctgtaaagagtcttcagcaattctagtgggatatccaagaggttgttgtgactttggccttggccaaacaccccaggggtgttataattggggggtgggcagccactgggagaggaagtgccaccatggctgtaagtggaagaatagaaacttcaatcgggagggatccagtacaggaagagttcagttctcagggagagagggttggagaaagcctgagtcgttgttagggcattagccaaatggccaggacttttccagagggaagctgggatataatcaggaaactagggcaggaggctaattctgcatactggatgcatgggccaggttcaggtgggtctcctgcccaaggcttgccacaggtatgccaggctttgggtggcaggaggaatggcagagctcagccactggagggaatgagcctgtgcccatggggctagtttctgatgggctcggtcactggaacaggttgggtgagggtggccatggagaacctgcaggctgaagatcttttatatttggcttatttattgagaggtctcagctctgcacatacataggaattggttttatttttgctaatcactgctttccactgtgctgaagcaagttcttctctccttctgtggagtaggactcttgaggatcctttgaccagggccatatatttcctgtcatggttaagttttaaaacctttttatttctgtatgacttagtccccctttttttttttttgaggtgagtcttgctctgtcacccaggctggagtgcaatggtgtcatcttggctcactgcaacctctgcctcccgggttcaagcgattctcctgcctcaggctcctgagtagctgggacaacaggtgtgtgccaccgtgtccagctaatttttgtacttttagtagagatggggtttcaccatgttggccaggctggtctcgaactcctggcctcaagtgattcgcttgcctccgcctccccagtgtgctgggattacaggtgtgacccaccgcacctggccgctttttgtttttaaaatatcagtttccaacctgattgacagtttgtcctcaacagcatgggcagagatgggatcctggctgctggtagcggaagagggtgctgtggtcaggctctgtgcacctcctccctctcccccttccagatgctccttcccttggtgctgggcacaggaaggacaggtggagaggcttagttctatgtgtcttccacctgcagagggtgtatgggggttcctggtcttgctgtggtccccccggttctgtctgatgctggtgtggcacctgtgtcttcctgtggtctcatctgtggtatataatcccaccctcttttcctggtgctatttcccttacccttgaagctgcctggacaggccatggctcctctcctgctgctctcccaacctgaaccttcttgttgactcagggaaaccactggagtcttctttcataccctctgagggccatagagaatggtattccttcactgaaggcaactctagtctttgcaagtggttttcttggagtccctcggaactggctttgagaaagggaaagcatcctcatcagtttcccatgagaatgtgagggaataagaaaagtagctaataggccagatgtggtggctcatgcctgtaatctcagcattttgggaggctgaggtgggtgaatcacttgaggtcaggagttcaagaccaggctggccaaaatggtaaaaccctgtctctaccaaaaatacaaagaagttagctgggcgtggtgatgcacacctgaagtcctagctacttgggaggctgaggcaggagaattgcttgaacccaggaggcggaggttgcagtgagccaagattgcaccactgcactccagcctgggtgacagactgagactcggtctcaaaagaaaaaaaaatgttgcactaaacatctttttccatgttaaggttgtctgtctgtatttaggaatggactttccttatgatagactccactctgtgatgtgaaatttgtacatcaaaggatttgaacaattctaagtacaaatttttatatgtgtgtgtgtttgtgtgtgtgtatgtgtagtacagttttaattgctcccatgatacatagtcattagagaaaacccttgttaaaaaaaaaaggagcggggaggagaaaggaggcaaagaaacacgtatatggatttgcgtcttccatttgccttgaattaaatttaatgtcattaaaaaacccactggccaggtgcagtagctcatgcctgtaatcccagaactttgggaggccagggcgggaggatcacttgaggccaggagttggagaccagcctggccaacattgcaaaaccccctctactaaaaatacaaaaattagccaggcgtggtggtgcacgtgcctgtagtctcagctactcgggaggctgaggtgggagaattgcttgaacccaggaagtggaggttgcaatgagctgagattgtgccactgcactccagcctgggcaacagagtgagattatgtctcaaaaaaaaaaaaagaaaaaaaaaagaaaaatagctaatacttacatagtgcagttctaagaatgttaaatatttcaattgatttaatccttgtgataaccatttggagtagacattagcctcattttatggactagagtggatatatatagccctacatcacacggtttataagttggcagatccaggacttgaaccttgtctttcgggcttaggtgttacatgtcactcttgtcacgctgaagggtccttcttttcctctctttatattgatttcctctcttatattgactgaatgggaggcaggggagtggtaagggcaggggaccagttttgacacctcttggaaagttgtgctgtagtagctggcatcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctgctatacagggtctgccaggaactgctggagaaaatcttgtaattgtgctggtgttacatatttatggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctgatcacgtatcactgtcaaccaatgtaatctactgtcccctccatcatcacacaatggatctacttcagttaagttaccaacatcttcctaaaagatgaatccagcaggcatttgtgtctttatttttgacaactctgctctgttgtggattttgaccatctccttctggaaacatcgtctactatgattcctaccacaccactgctggttaaacttttaactctctgttcactatgttttattttccagcctctctttctctgtccaactttttaaaatcagtgatcacgaggagtttgctcttggtcatctagtcttttcactcagttgatgttttgtgtatgataccatgactctcatgataacccatgtggtcacctgttcataattcctgtcctgacatttctcttgagctttaggcagcctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggggctctatctttcttacccctaggttttttaatgtctaaggcctggaaaaggaggtttacagttagcagtattttattaaatacttaactcattaaagtcataaatgtaaaactgattctacattaaactttaaaaaataacttacaaattttataaattcatttgtaaatctgatatttatgttaaaatgaaaggcactccagcctgggcgacagagactccatctcaaaaaaaaaaaaaaaagaaaggcacttatctttgaacagtgtttaatttataaatttaaccaattaaatccctcaattaatactatttataaattctgttaatttcccttaaacattttaaagtgtagtcatacgtgtaatcatatgttcaattagtcatccagttctcacagagatccaaatctgatcaaagaaacaaatgtcattcactaaataaatgtttactgagtgcctagcatgtgtggtaactgctccaggcttggagactcagtgattaatagtcaatgaaatgaccactgaatggtaaataccgagaattgtgccaactgtaaacctgagtaaatgattattagtgttttaactagtgtcactgcaacctgagtaaagtatataaaatcctatcagtacacaggaccttagaacaaacaaatacacaacaattacacagtagggcctggccacagaatgaggagatctgaataaaatcctggaagatgacactagaacccaagagcctcgcaactccctgatatttaaaagctgcattatttcaggaaaaggtaccagtctgctgaaaaatggacacatgacactggagaagatcatctgaaagggagagggtcgggaagtcctgttgactgctgatgtggcagctatttgatgataatgaggggctgaacaaatgccagctcagatggaatcattctggaaggtgcactcacattctgagtccaggccctaatctccagtcagtaacatggagcttgactttattgtggttcccagtattttatggggtaaccacagctgacctgaggtggttattgtgctgtccttgattgggcgaactacttggaaatttgagataaggaaataaatccctggtgtcaatgcttctgtattggatataatgatagtaataagatatattgatagtaataagctttgcaggcatttttaggtgtgtgttttgttgctgcctccttttgagcccctcttcccggaccacacttttgctggagttcacagagcaggctggagttcatcaatgaagccctggaccaatgtggccttcaggccccacatgctgagccctatcaagtgccatatctctctccactattggtcttgggtgagatgctgcattgggggcctagaacctggcttctcgagtggctgtccaagggctggagggtgaaacccggaagtgttgggtctttggctcctatggtgaacctcaaccaatgggagaggataggatggcactgggcagatcaatttcccttcctttctcccttccagggactactctgaggtgcagtttcttcttgcagctctttgtgagaaagtccggtgtgctgatggacatggttgcctagtggcctggagtgttttgaaggtggctggtgcagttacaccctttatcccacaatccttggactctttcttggccttgctctctttcctcactcttacctgggctagtaactcgcacaataaattgtcactttaatccttgtctcgggctctgctttctagaagacaggggctacgaaggccctttgaaaagagttataatcatggattttggaatatttcttgtcctctgtgtatccctgaaacttagtactttttggaattggcttatgcttttaatgacctttagaccagaaaatattatatttttaaattgttttcacctgacgtttttagtgttccaaagttgtatgcttatcagaaataagcaagaactctgcaattctttgaaggccaacagcttgttacactgtttatagcataattaacaactttataacatttatgaaagtaaatggattaaatttgtaattattgtctggaaaaactgtatttttacattttatgaaacttaagcgactcaagttatgccatatttcatacataagctgaactttaattttagattcatgattagtacatcataaaagtactttctgtgctaacatttttctcttcctgacttatatatttaaaaaaaattccctttgctaatcatgatcctgtttaatattcttgggaaggttagaggtggaattcagagtgagattattggcatcgcaagaggaacagacactgaaaggtcaatttattcaatttcgtgtttgggtgcaagatctcagttactcgtcctacacatgagaaaacccttcttgcctttaagatttactggcttctggctgggtgcagtggctcacgcctgtaatcccagcactttgggaggcctaggcaggcagatcacctgaggtcaggagttcatgactagcctggccaacatggtgaaaccctgtttctactaaaaatacaaaaattagccaggtgtagaggcccacacctgtaatcccagctacttggaggctgtggcaggagaattgcttgaacccgggaagctgaggttgcagtgagctgacatcatgccaccgcactccagcctgggcgacagagtgagattccgtctcaaaaaaaagaaaagaaaaaaaagacttactggcttctttttagacacagtttgcaggaaaggaagggaacctaataacccattagaaaaataggtgttttataaataatgttaattgcagctatttcacattcagacaggtataaccaagactaagcttcactctaggaataatataaagttttaatcagaagaatagtttcaagttcttagaagaagtggtgtgtctttagatcaagtgacaactatgtgtctaaattatagcctttacccaagggtctacagactttttaggaatgaccttcacctgggtgggatgcattcccctcatcagtgtgtggaaatggacagcggatcagcatcccagagcctaagggtttgccgagttggtgatcaccatcagcagcaccttccttgggtgccccagggcaagtgagtaaccactgccatgtttggtgtaatggtgagtggaggtatcccacccacagtaggagacaggagaggccgaggcctccacacccacgtgtgcatacttcctggattcagcatgtgtctcccaaattacccaggaataggatgtaatgccttgtatctgtgacttttggaggtaccttatatatgcctgtgtgaatgaataaatggatggatatgaataaatgaatgggcctggggtttttgttttgtattgaggcaaagtctcagtctatcacctgggttggagtgcagtgtgccatcatggctcactgtagcctcgaccttctggggctcaagggatcctcctccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggagcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattattacatttacatatgttcataaaaatgcaaaaatgaaatgtactggcttctaacctgcttttctcacttaatatattgtgatgatttttctatgagaatatggatccacatcataatttttagaagttgtataatatggaaaaactacaatttatttaaagttttctaattgttagatatttaagttgttaccagttttcactaataacaataagtgaaatttattgagtgtttgctgtctcagattatgagtttaagatgtttatatgcattatttcacctaagcctcaacaaccttacggggtaggtattttgttctcccccagttttacagatgagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggaggcagatcctctgcctttcagatgactgcagccctggcccacagcttaactgcaggctcatgagaaatcctgggccagaatcacccacctaagctgctcctggattcctgactctcagaaactgcgtgagataacagccatgtgagctgttttaagctgctgagtttgggggtaattttttagcagagtaatagacaactaacataactattctgacttttataataataatttccttctttatcattacaattttaccaccaatatgtatgcatctctaaacaagatagtttaggtttgcatatttttacctattttatacatgtattttaaaattgggtcttatctcgatattaggcatatccctatagttgcatatagccagcgctcattttatttgcaatctagagattcattgtatgaatacaccacttacatacgtatctgttctcctgttcgtggtcatcggtgttgtcctgggtttgagactattatgaaaactgctgcagtgaatattatgggcatgtttcctggtgcacattccacaggcttctctaagttgaccttgtagtgcactcgctggctaaaggacatcggcatcttcactttttctttaacattactagataatggccaaacctcatcaaataatgccagattatactccaatctgcaggacgtgaaagttcccattattttacatccttgccaatccgtggtattattggtctttctgatttttgcccatctggtgagtatgtaagtgatatctcattgggattttaattttgcattccctgggagtcaagaggttgtgcactctttcatttattgattgactacttgaatttccttttttttttttttttttttgagagatggagtctcactctctcatccaggctggggtgcagtgatgcgatctcggctcactgcaacctctacctcctaagttcaagcgattctccgcctcagcttcccaagtagctgagattacaggtgtgtgccaccacactcagctaatttttgtattttttagtggagacatggtttcactaaatgttggcgaggctggtcacgaactcctgacctcaggtgatctgcctgccttggcctcctgaagtgctgggattacaggcatgagccactgcgtccggcctgaatttcctttttagtgacatgcttgttcaagtattttatccatttttaagaaattagttgtctttatttatttgtagcagttctttacatattctggacactagccctttgttgttatatgctatacaaatatcttctcttactctgtagtttatcttttcactctctaaagcctaatgatgtcttttgataaaagaaattattttactgtaatagggtttattaatcttttcccatatttgttttttaacatgtaggtttttttcgtagttgattttattagtctttgccattatagttcctgacttttgaaatcctgtttagaaaggcatccctactctgagattacacaaatattcacctacatgtggtggttttatttttatgttttcatttaaaaatatttaaaccattcatctgaaatttttttaaagctttggttataacattttttttccctgaatgtgatgaatacggttagcaaatttacagaataatctgacctcttcctactgtaaatgctacccgtattatgaagtgggatcctatatattggctgtatttctgagctttctcttttgttaattgctcattctgttgattctggcactttctgacacctacttgtagttgttgtgctctgcgggacacatctgatagggcctgctcctgcacgttactcttgtttttcggcattgtcctgacattttttacatttttgttttctagatgagctttaggatccctttaatattaacataattatttttggctgtgttgtagatttgtctgtgacttgttagaaattagtgttcccacttaggaatgtggcatgtcttgccatttacttttgaatctttttatgtccctcagaaaaattttgtaggtttcatttcaatagaggtctggcaaattcttattctaagtttttaaaattttttgtttctggtgtgaattggcccttttctcctatgcgttttctgatgcataggttttcaaacctccactccttcagcgataaaggctcccaaggagtggctgaaggctggggagcatcgcagctctgccccatctgtttaccgtaacaggttttgtttatagaaatcattctcttttgctaaaaaaaaaaaaaatttcctgattggttgttactgaggtttgaaaccctgtttttgtgtacgcttttttttttgagacggagtcttgctctgtcacccaggctggagtgcagtggcacgatctccgctcactgcaagctctgcctcccgggttcatgccattctcctgcctcagcctcccaagtagctgggactacaggcgcccaccaccatgcctggctaatttttttgtatttttttagtagagacagggtttcaccgtgttaaccaggatggtctcgatctcctgaccttgtgatccgcccacctcgacctcccaaagtgttgggattacaggcgtgagccaccgtgcccggcctgtgtacacttctttttaatgaatgatctttactgatatcttttgttggttttaattacttttttagtgattcatcttggatcttccaggtattcattcctttattattattattattttttttttgagagagagtctcgctctgtcgcccaggctagagtgaagtggcatgatctcagctcactgcaaccctgcctcctgggttcaagtgattctcctgcctctgcctcccgagtagctgggattacaggtgcatgtcaccacgcctggctaatttttgtagttttagtagagatggggtttcaccatgttggccaggctggtcttgaactcctgacctcaggtgatctgcctgccctggcttccaaaagtgctgggattacaggagtgagccaccgcgcctggcctcattcatttatttattgaaaaaatatttattcagtgcccacccactgtgtaccagacacatttctaggtgcttggaatatatctatgagcaaaatccatgtatatcatatggtaagctcaaaatgagtatattatacggtaactactttggagaaaaagaaaatggatcaagggttctagaggtgggatatgggatccaggcagaattttattttattttactttattttatttattgattgattgagacggagtcttgctctgtcaccaggctggagtgcagtggtgcgatcttggctcactgcaacctccacctcccgggttcaagggattctcctgcctcagcctccggagtagctgggactacaggtgcgcaccaccacgcccagctaatttttgtatttttagtagagacggggtttcaccatgttggctaggatggtctcgatctcctgacctcgtgatctgcttgcctcagcctcccaaagtgctgggattacaggcttgagccaccgtgcccagcccaggcacaattttaaataccgtggtcaccataggtctcattgagagggggacatttaaacgaagacttggaggtaaggacgccggctatgtagatatctgctggaaaagcatgcttggcagaggggaaagcctgtgcaaaggccttagaaacacgctggaggtgttcgaggatcatggaggggtgtggctggagtgcagtgagtgagggagtcaaggttggttagggagggatagagtaggggacagatgtttgtatggggccttagtgtaaagactgacactgagtgaagagaggagccattgcagagttctggaatattgtagggacaagatgggcttacttttttttttcttttgagatggagtctcgctctgttgccaggctggagtgcagtggcacgatctcagctcactgcaacctctgccttctgggttcaagcgattctcgtgcctcagcctcccaagtagctgggattacaggcaggtgccaccacacccacttaatatttgtatttttagtagagatggggtttcaccatctggttggccaccatcatgttggccaggatggtcttgatctcctgacctcgtgatccgcttgcttcagcctcccaaagggctcggattacaggcgtgagccactgctgggcttacatttttaaaagatcattctggttgctcctttgagaatagattttagaggggccggggtagaagcagggagactgattagaggcgattgtaacgctcctcacctaggatcttactgtgcattgagcaattggtaaggcttatggaatgaatgtttttacctacatcgggcattttagcgtgcattaagaaactacacatttaaaaaatacatatttttcttgagaaagtgatgggacagaaaagtgagagcaggggaattgcctttggaacaggccattttggtcaagccttgtcctggataaagaagatggggaatgaaggctgacctgccgtggaggggaggaatgggcaggcatgccctgcctcatctcacggagtgagggcagaatctggggagcgcgttcttggatgtcccaccaactttggagaggaccggaggctggggatagacaaggactactatgatgaaggaagctcgtaagttcgtgtttgcttctaaatggttgctgtggctttctggctttaaactggtttatattttctgcaacctcacttcttcctaactatttagtagaccagaacttctcggtaatttattgctcaatagtgggagaaaggaagaacttcgttttcaggttaagacttcatatgtcaaatccagttttattggtgtgataaatgctggtttctgttaaatttaccaggttggtcagtactggttcctgatacaagaactgtatttacccttttaagaagatgatttaaacttctggagaaaggaagagggcaaagatctttaaagagtatgctatttttatgacgcctccctaattattcagaaatatgaataattcaggaatttaactgtagaataagtataaattacccggttactgccttgaaagagtttacaatcaccttgaagagaatcctgccctcacccccaccagtttcacaaagcctattttaaattatacccttggaaaaattaaaccaaaacactgcgcaaatatgtttggtgtggagttcatttctttgatttagtcctttcactttgggcccacacacttttgccatcctttagggagcatgcccagtgctagattcgaagcgaatatattaatgtatgtgttcacccatcaatgccttgtgctgagggaaaaacagaagagagtgtcatggaaggcttaaggattcttttttttttttgctgatacaaagtactttttgttattcaatgcttgtgccatcatcagacaacttcatccagaatgcacagcaactctgtaatatagctctgcctggtgcaaaatacctcattttgtatagaaatgcaggattgcttcatgtagatacaatagaaagaatctttgctttattcatgtatgaataaaacgtctttgttcatggaagagaaaagtgcctcttattgtttggaagctgtgtgaattttaaattaagctgatggcccactatattacatatttcgggggaaaaattagctttgcttatataagtttggaatctaatgtctaacctagtggcctaaataatttttgctttgcagtttgtttattatgtaaagacattgtgtttgccacagacattgcctgtcaatgaattgctttagcaaaattctatagtcctaattttaaaaagttgttatttattcccttgtcccacataagatttgaagcagcttgcaaaaaattaaaaatacaatgtaaataacagtcataaatcatgatcagagaaaatataaatattttatggaaaagtcaaagcttgtagaggcatgtgtgagtgtatttatgtgtcaatatacatgtaaaagggtccatgaagcagctatgtggatcctcagatttgatgttgagcttcctggcagccaaagtggaaaaaggaaggcaatcagttaatcctttctctgggtttgcaaaggactgcttagagcatatccaccgccaagcaggggtatggcattcgggctttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggatggacagtcactctccatgagtttttgcaccatgtcagcactataaactcactgcagtgggagtttcgcattgacaagggtcttcagacctagctcacctcagaaggtaaggggggccttgacaggtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagttttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctgcctccctggcctccctactcctccatcccctccaagactctcaatgtagtcagcgctctgttttccccacctttgcctggctgccacctccctccctccctctccctatcagcttcctccggatgaggtgctattctgcatggaccccttagagtactcattaactagatgaataagctgccagcaatattgttcctgcttcccacattttaaaaaggttatctctttctttttccttctaaactttagagccatttgaaaataatcttttggaaatatatttacataggtctcatgacaaatccacatactccttttcagacaggtttcaacgactgcataatgagatggtctgggtcagctttgcacaaaagttgtacttttcctgctgtgaatctgtatttttccgctgtgtgtatttgcaatgactttcccgccctaccttccactagtgatgcattaatcacagcatggagctgagaggcgtgggattggaagggtctttgagaagttttttaatcgagctagaacgaggtcaaggttttgagcatttaacttgtgggatgttaattacttggctatgaaaaggaaatttgttttctgaaagttcaactgtagctacagaataaaggccatggaaagataaggcatggtgtcaagaggtttcatgatcttattccacctccttttcaggccccaactccactcaaaccctccactgttgagccacactggatgtgtcaccctctgtccctagacgtgctggacatctgcatcctgtggtgcctcggctcaggcttctctttcatctgggaaaacccttgaccctctcctagacttcccaaatgctgcttcaaggcatcatccctgccctccttcctttagaaagtcttttctaccactgagaacacttccctcatgctccaccgcagactgtacttcatgctgctttgctctttgtggttgatgcatctgtctctcccactaaatcatgaccctccattcatttctacttcccactctacccagggcatggtaggtgctcaataaatctttgctgaatggaattttttcatctaacccaagagcaacctgagcagaaaatcataaatgaataaggatcgtaaatggatgatcatcataaatgactaatcatcataaatgaatgcttatgggatatacacaaattgcagaacactgatagctatggcatagctcttatcctagagtgagtttcaattcactttaggttaggacatagaaaagacaaggagaaacaactagtccatgaggattttttccatgctttgttctttccatctgtgctgttcagtagctagtttcactgagcttccctgtagtggatgggtagagattgtgtattataagtacttgctcatcagtggctcaagggcaaaaatctcagtgcctagagtttggcataatattatgtgaaaaataattttttgcaatataatgagatgtgacactccccactttccagaacaaggacttgtctcctttggatttccagacctaaagaagaacatctcccttgaaaaacttttcccactggcaattcagccctctgttttccaaacccacttagaagctaagttgcactggaaatacacaatgaaatgtttatgggaaaaaggggcatcatatccacaatttgttctcaaaatgatttagtggagggagagagagagagagggtggaaagggtgggttggagggagcaaaagagagacagagaaaattgataaaataaatgagataaaattgagggaatctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatagctttaagacaactataaactccaaacatttcaaattaaatgcaaataaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtactgactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtgtgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttctttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggcgtgagccaccatgcctggccatgagtttcattttaatttgtgtttccctcattttgattgaggttgagaaccttttcgtatatttattggtcatttggatttcccttgttgtgaaaggtctgcccaactattttgtccatttttctctttttcagtcttcttattgatttgtagaatatatattcattctggatataagcccttgtcggttttatgtcaaaattatttattttgcagatctctctctcttcttttaaaaataattttaacctttaatttagattcagggggtacatgtgcaggttttttatatgtgtatattgcatgacgctgaggtttggggtacagttaatcatgtcacccaggtactgagcatattactcaaaagtcagtttttcacccctcacctccagttctccctcccccttctagtagtccccattgtctattgttgccatctttgtgtccacgagtacccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccactgctcaagtttttgtttttgttgccactgcttttgaggacttagtcataaattctttcctaaggctgatgtccagaatggtgtttcctgggttttcttctagaattcttatagtttgaggttttatatttaaatctttaatccatcttgagttaatttttgtatatggtggaaggtggtggtccagtttaattcttctgcatgtggctagccagctatccctgtaggtgtgcagctttatttctgggttgtctgttctgttccattggtctacatacctgtttttgtaccagcaccatgatgttttagttactgtagccttatagtactgtttgaagtcgggtaatatgatgcctccagctttgttctttttgctggtgattgctttggctatttgggcactttttagattccatatgaactttagaatagttttctctagatctgtgaaaaatgatgttgctagtttgataaggatggtgttgaatctttagattgctttgggcagtttggacatttgaacgatattgattcttccaatccatgagcatggaatgtttttccatttgtttgtatcatctatgatttctttcagcagcgttttgtacttctcctcgtagacatatttcacttccttggttagatgcattcgtaggtaattttttgtgtggctgttgtaaacaggattgcattcttgatttggctctcagcttgaatgttattggagtatagaaatgctactgatttttgcgcattgattttgtattctgaaactttactgaagttgcttatcagttctaggagccttttggtggagtctctagggttttctaggtatagaatcatgtcatcagtgaagagaaatactttcacttcttttcctatttggattccttttatttctttctcttgtctaattgctctggctaggacttcctcttccactctcttactggtatctgttggtcagtggaagttcttaattttagtgtagtcaagtttatccttcttttccgtatatggtaagtatctatacgtgtaagtgtttatacgtagctgttttagacatctttttcaatcccagattatgaagctactctttatttcatcttctaaagctttatagttttgtttttcacatttagtattgtaagtcaagaactgtggagtgtctgaaattttgccttacttgcaagctaacaagttagcctgccttagtgtcacgaatgttgccagaagacacaagactccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcgttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactatctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagcaaaacctcaactttttaacaaaagaaaacaaaccgtagagcaaaggagattttctttcattagccagggtccagttaggatacaggaaccgtgctaagtatttcacatggaagggatttcatacagggatctggctatacagggtctgaaagtttgaaaaaattaaaaatggacactacctttaggtgctgggtgacaaaagggaagaggtggcaatataaaatctaggtgctcagagaaggagctaccttggatggtgctgaggatggggaggggagagctgggaatggaatggcccaggagataccacagcgctcctgctttacccgctgctggaaggatgaccgtcaaggctaaaagcaggaacacagtcctttcttcccagctccttctttccactgtcacaacataaccagaagccagcagcaaggaagcctgagaaatgtagattgcagagtagaatcactgagtggaggttggggctgagagacaataggcaaataaccagcacagagtctaagcagcaaaccgttcagattagctcctcctacaacaatgtgaaaattggaatgctcattttgttgctacttctaggaactgtggcccgtgggtcagttgggaattaatggcaaataaaggagattctggggcagtgtttgcttatgtgttgtgtctgattaatttccaaaatcaagctgaattaattttggatttatatgcattcatttttgaggtcaaggctagaggtcataatatctgaggtctcattctcgccacttttcctattgctggaatagtggtgctatgtcggggagaggacacagagaggaacaggcactgagaaagggagggaaatagtgggttcagaattgggacatccaggaggcagctggaaacgtgagtctggaactcttgggtgagatttggggctaaagataacaatttgggtgcttgatggtaagcacatcctttgagagtatatgcagtttcccaggagagaatgtgggagaagagttgagggaagggttgaaaaccttggaggacaccaacattttcaaagttagaggagccagcagaggcgagctcatcctaatggagatcacttcgttcaagcagattatttgcttgaaactttcatctttggtattatttgcactgtagtggaatgaacaaccataatgtgagtttaaaacccagataccaaaatattgtttgtttatagtctccctcaaactccatcttccgtaagtgctggtgtggggattatgtacctcttcacttctcttctctgcactgttgataaaggaagaggcaggttttgctgaccacattttggcaaatctgttggctctttcttgggcattcccatgctcatggtcacaatactgttactacgttaatttaactctagaattgagtttaagccactaatcacaatttctttttcttgctttgtcattatagctgctttttgaaaagcaaaattactaaatttcttaagtcaataatttcaggttgataaagaagaggcaaaatatatgcaggctttaaaacatgctctgagaccacagaagggtctttttctgatccaaatatcctattaaaactgtgtgactataggaaaaagtctgtgtaggctagagcaagttcagttgaaaacctatttttaaaaacacttaaataattacctttcatcctaaatcatagacatggtcagcattgtaagaaaagctgatacacccaaatctgaatatatatgacaaatagatcattaacaccctttcattttaccaaagtattctttgatagtgcctttaaataagccagtttctaaagtaaatttaaaatgtcttcaattataaaaaatagatttacatgtgatgtttcaaggacatatcttgtgaaggaagtacagttgtaaagtgttgagcaaagtcatgaaagttttcacaagaaggaaaagaataacatttatttctaccttttcttttttcttatcagcatctcaaaatagaccaacagtatattccattgttactatttatttgctgcaatacaaatgacatctcatttgattttagccctttaaccttgagctaaaatgaccctgtggaaacaaatgagcactgtagagacacctgcccctcagaagagtttggaagggcagagttctgtgggagagtttgcctaggaagtggtgcggggtgggctgcccgggaagggtgtgtggagtagagaccaagaaggggctgaacgccatctcccaggaagcttcccaagactgacttttcttatatgtggcctccaggcagaggtggggaaatccccaagccttcccagagggcagtgaggctttctcaccttaacttttgagttaggaattagttcacattagcagtttttggctccctgaggctgagattggggagcttttctgaaatcatggaaatttctggcccttatctctagatgaagatcccaccttaattttatgtatccaacatagcctaaactattgttctttttttctgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtaatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatacaatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaaggcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttttttttttttttgagacagagtcttactctgttgcccaggctggagtgcagtggcacaatcttggctcactgcaacctctgccttcgggttcaagtgattctcctgtctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcgtctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctatcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatatggtaattctatttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtatttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctctattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaggtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatctaagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccggctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactgtagcaccaaggcaacctgagataggtctaatttgcagcataaatcttcttttccactgggggaagaacacacgagccacattgagtagccacccatttgtatttttgatttgcaacttctgtctagtgagccaaggtcaggtgcgatatttgtgatggggaagctgaataggtgagtgagggtagcttgtgtttgaagctgaagaaggtaattaagagggttttagaatgtaattttggcatttttccccactccacctcttcaaactatgtgtcccctgtcatcgcctaaccgatctgcctgtccaccttctggttcctctccagtccattatctcatggcccacttgactaatctttctgaaactcagatctgttcttatcactcacctttctaaaagtctccattgtccccagaattaagtttagccccatggtctggcccctgagtgtatgcctgtctgctccttttcatttaagcttctgttacccttgctgaattattatgctgtttcctgttatgttgtgtgcatctcttagaagctgcatatagctggattttttaaaatccactctagtattatttagtatgttgaatgtaatccaattgtgtagataatcattactgatctatttggactctctattttttaatcagccatttctttgcttatactattctttctgacagaaatgccacttttcttcttatctccctggtgaactccatatatcctactaggctttgttctggaactttcttggcaccttctcatttatataattgcttccttccatctgggttttaatggcaagttctgcatctctattacagaatagtattgatctcattgtggattgctgtttgtgtttctgctttccagtgggcctgtgagagtgactgatctttgcatctctagcaaattggcacagttggtagactttccaacctgagatattagatgtttcagaaattagattgaatgacgtggtgtcagtttgaaacattaaattgaggtgttctttgaaatgtatttaaggttatacaatgatttttgaatacagctttagctgcataccacagattttgatgtataatatttttattgttgttaaattttttggtaatttctattggggttttctttttaatctgttatttaggacagaattttaaaattttgtgctgatatacttatttttattgttggttcctaacttaattgcattatggttaaaaaaccccaaaacctaataaacatgctctatatggtattgattgactttgttacgtagtattaggttggtgcaaaagtaattgtggtttttgccactacttataatattttgcagcaacataatatatggtcagtttttgtaatgttctatctgtacttgcaaggaatatacattttttaaatttattggctgggggatataggtatatgtgcataatagttgaccaaggttattattttggtcattcagataatcaatatctttttcaattttttatcatgtttgatatgtcagttttctgatggagttgtgttaaatctcctgctgtaattgtgggtttatcagtttcactatttcagttttgctttatattttttggaggttatactaatagtggaaacaatatcattattataaaaattttggtggattgctccttttattattacattgagtctctattcctattaatgctttgccttaggaaggtatttcttaggtcaggcacagtggctcatatctgaaatcccagcactttaggaggtggaggcaggaggatcgcttgaaccttggagctcaagaccagcctgggcaacatagagaaaccccatctctacaaaaatacaaaaatgagccaggcatgatgctgtgcacctgtggtctcagctactcctgagatcacaccactgtactccagcctgggcaacaaagcgagaccctgtctcaaaaaaacaaaaaacaaagacaggtagctcttgtctgatattactgctgcaggctttattttgattagcattttcctagtatgtacattttgtcttttcagtctttctatgtgttgtgttttagttgtgactcttagaagatgtatatagctagattgttaaaattcactctattattatttagtatgttgaatttaatccaattatatagatgatcattactgatctatttagacttattactatctgattttgtggtttctgtttgccattccttcttcctccctctccctttattctcccttgttttcttttggattgaaaaatactggttttctaacagtgtgctggtatggatactatgttataacatgcatagttctatatgggtatcatagttttgtgtttttaggagttaccattagttatataacacagatacctgctgtgcattattgtaatgatgtctaaagttatacccatttctcacctcctcctgaacacacatgaatcttagtgtgcttgaaatatccactcaacacccttccccatttctgtgttattattgctgaaggttttaattttgcccttgtgtaaactcagacacattggtttttgcttgtttgtttgcctttactcaatggtaaatttaccaccatagtttctcaatttttattctcaccgttgtttcctatggtccatactttccctcttggttcggtttttatttccttgatgtaatactttagcatcactgttatttgagtctgtgaagtctgaatatgtctttattttctttctctcgctcttttttttttttttttttgagacagagtctcactttgtcactcaggctggagtgcggtggtgtgatctcagctcattgcaacctctgcctcccgagttcaagtgattcttccattctcccacctcagtcttctgagtggctgagattataggcacgtgccaccacatccagctgattttttttttgagacggaatttcactcttattgcccagactggagtgcaatggcgcgatcccggctcaccgcaatgtctacctcccgggttcaagcgattctcctgcctcagcctcctgagtagctgggattacaggcatgcgccaccacacccagctaattttgtgtttttagtagagacggggtttctccatgttggacaggctggtctcaaactcctgacctcatgtgatccaccacttcggcctcccaaactgttgggattacaggcatgagccactgcacccagccttgctcttaaacaacagtttagggagacagaaaattctagatttttattgcgccaccacacccggctaatttttgtatttttagtagagacagggtttcaccatgttggccaggctggttttgaacacctgacctcaggtgatccacccgcctcaacctcccaaagtgctgggattacaggcatgatctgtaatcccgtgcctagccgatttcttcttaacactttgatgccattccttcattgtccctggcatctgctgttgcagaagagaaatctgctgtcaatcttattgttgctttggatgttttttcccctgcgatagttttaggattgtttatttttgaggttttgctgcgtctgggtgtgaattaatattcatcttgcatggtacttgagtgtgcttccaaactgtagactcctattttccttcaattacagaagataaaagagccattttacttgtaaatattgattctcctatattctgttgtttttttctggagtgcctgttggatatatcttggaatctctcacttatccttcatatctattaactgatatttccttaaaaaaactcttcatctctgtttattttatgttctttaagttccttaatattttccagcttaccagttctttcctgattgcgcccaggctggagtttgtcccatctattgggtttttcatttttatgactatataatactttttgtttctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattgcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattgactgacctctgaaatataattacgtggcctaaacagctaatgctatatgtgtatttatacttaatgtatcaaaacagtaaacaccactgggaaattcaggaaaagcagaaacgaatgatcatgactcttaacctgtgactcctgttgaaaatgatcccatatgttgtcttttcaaacaagatatattcatgtcactagtttctgttcttgaaagtagaaacactactccttctattagacattttggtttctgaaaatagaacaagtaaaacctgaacaagtgcgaactcgttcggattaaagggatttcgggtccaactctccaagccaaagggattttcaaatggttattttaaaacgtggatctacatgtgggcttctgtggtttcaatagtcacaggaaatgcaggccactgtatcagtcagcttttgctatataacacaccatccgaaaacacagcgacttaagacaaaaaaaaaagttcatttagtttatgattctgtgggtcagcaatttgggctgggagcactgggtgggtggatgtgctggtgtggttgatcgctgctgggctcactcacctgttgccggtcagctgccaggtgagctgagggcttgatggcccgaggttgctcaggtgggatggctgatctctgatccacgtggtctttcattctccaacaaggcagcccagacttggtcaggtggaagcagtcacagcggacctgacagagtgagcagaagtatctgtagagcctctttgtgagtactgatttggaatttatagctatacagtgtggtttacactcttctattggccaaagcaagtcgaagcgtggaaaaatagacttcttaatgagaggagctgcaaagcctgtggccacttttgtactctaccatggcaacaaaacgtggaggtgccactccccaccccaggagagattgtgtaactttccttagatcctcaggctattacctccaaagttgagaaccaatatgttggatgatttcactactgaacaacaacaatgaaaatgtttaggagagttaactgatggacacatctgttaaaacactgcttggtgtgtggaaatgaaatttttcattttttctattggaagttatgccttgtatcaagacattaggttaattctctctgacttctgtactcagcctgaaaagtaaggattcttgttcagtgtaccagataacttctattatgtggcaaaccactccaaaattcagtggtttaaagcaataccgtttattggactcctgttcccatgcctcagcagatggggctgatctcagctggggtctctcacgttactgcagtcacctgcaggtcagctgggtggctctgattctggggatggactggttgtaccttggtgggtgtctgggccacttgtttctctccattcagttaatttgcctgggcttgcttgttcacagggtagcaacagtgtttctagagagtgagtagaagcacacaagatctcttcctgcctagctaggcttgtttctgtggggtcaaaacaagtcacaagcccagcccagattcactaggtgggaagatagactccaactctagctcggaggaactgtaaagacgcaggacagggaggatggagaaccctggccattttgtagtcttctgtatctgttgtcttcaagaaattccttctcacacttcgaatttaagtaaaatactatctccacttatatttttcctattaaatagtaataccgcatgtgtaatagtagtagtaactacacttgtatttaaaacaacctgccatcttttcacctttaattgatggcacctcccttactgtggatttgcatattcatattactattttaagggcgtagattatgttaatgtgttttgctaaagaaaatgattgaacttattttcttcttccaatttgtcttcctcgttctttaatccaaccctactggtgccagacttgcttttctaaagggtttctctgtgtttgatgaagactctttagggatctctcactcgtactctttagcttggcatttgagaatccctgtgctctgggcgttgcgtaactttcagattttattttcctccattcttccttgtgcactagttttcacagttaaacacaatttattgctgtttttttttcttagcacattggccatacacaaattgtcctcagctcttgggcaacatttttggttgttacaaccgtgtgtgtgtgtgtgtgtatatgtgtgtgtgtgtccatgcttgtagtactggcctttagcaagcagagaccagggttgctgttaaacatcttgcagtgcacaggacagcccccacaacagataattatctgctacaaatatcaataaagccgaggctgagaaaacctgtcctatccattcctgcccctggctcttttttccatgcctcatcccagaaggcctttccttcagtgccgcccgatgaaatgttctctatccttaaaatgccagctcaaatgccacatcttctaggaaacacatcccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctccccaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgacataccttaaattacttaaaaaaaactcttaatatacaaataggtgatgtatagctttgttactaacaaaatgattcagttgaaatgttaaatttaaaagcatttttccagagttttagttttggttgatggattgagatccttcttgcttacctccttttacctccaaaaaccccagtgagttacagaagaaatataaagtctattatctgttttattacagcagtgaaaagcatggaaacatataatacatgaccagaagttttaaaactttccagaagagatgcattagatggtattagacccacctaataaatgatacagaaatgagaaagtaatgggaaaaaatattctataattaatgctaaccatataaaaatagaggaacaatagtaaaatcaaaataaaatttgatgcaagagaagcactaaattaaaaaagctttttaattataaaaagatacagtcaatgtagtctatcaggaaattataatagttatgaaccattctgcactacataacatagcatctgaatttttaaggtagaaactgtcagaaatacatagacagttgataaaaatagaagtagacttcacatacctctctcataaaataatagattaaactgacaataatcaataggctcatggaggatttgcataaaatatgattaataactttgattataaataaatatagatatctgcattccccaaatggagaatgtgcatatttttcaaattcctttggaacaaatatggttatcaattatgtactaggttatagaaaaaaaaactcgataaatttcccaaagtgattccatagaacataagaattataagggaaagtagagcttctaaattctggatgtttggaaatttaaaaatatgtaaaaataattcttagtttaaagaggaaatggaaagtaaaatgacattatttaggcatgagtgacaattctgtatgtcaaaacctgtgatatgtggctaaactgtaaatgtatttaaagaaaataaatgttgggagaaaatgaataaatcatgcaatccaagaagctaggaaaataacagcaaattaaatcactctaggtagaaggtagaaatcaatatggataaaaaaagagattaataaaatagaaaacaataaccacaaaagatcgaaacaatgaagccaagagctttagaaaagctgtaagacaacaaacctctaccaagtgaggccaagagggagaaaaaggaaaaacacaaacaaattacataaagaagaagaaagaggatatgcccactgatagcattttttaaagagaatgctgtaaataagtgtcagaaatgagagctgctagcagctctctcactcagggactgggcctaagggagtcagtggcacaggccttgggacacctcatgggcagggtgccagcattaaacagaaattccagacttaactaaccaagatgctgtcataccaggttgacttcacaaaaaataatttttaccattctgcttccctctatttttcttaatggtttggcaggatatttgcatagcatttggttgacttgaacagacacacacacacaacacacacacacacacacacacacacacacacacacacacacacacacacactatagtgtccctagttattctaggagggagattttgtttttaagctacatgagtttttgttgttgtttttttgttttgttttgaatgctcatcttgactccacattagccaatatgtttactcttcaatttgtaaagggtttatttctagttttgatgcttgggctggtgtggaggcagctccagtatgtgcatgtcagggcctacaaggtacctgcaagtttttggtcatttgtttcttgggcttttttgtttcaaaagatataaaaaagatctgaagtagaaaatatccccattctaattcctctcatcatcatctttcagagatgactcttagctttgtggtggcttttcatgtccaaaaagggttgtatatatcaaagggagcactctaagttatattttaattaatatctaatttgttacattataaatctaaaatcctcatttttcttaagctttaaactgaacttatgaatcttgtttccaaatttagtaattttgctatatgatgaaaatcattatagttaattttcatttgaggttgcattaattaacacataagcttaacagattcaatccttaaatatttaccaccagttatataattaagcaaattcccttagacatttcaagctataatcacaaaggcaaggtacaggactccctcaaactttacataaaatctattaacagcattttcctaagcccttacatttcttgtgactaataagacatatttagttaatcagattctcttaaacatttcaacaatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacctaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaatttgctcgtgtgtttctaaaaggacaaatccttagaagtataatagctggtttattaatatgcccattaataagcacttctcccttgatctccaaaaacgtatcattttgcattcctgttgtgtgttactccacacccatataatacctgatattgagtataactgattttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcaccctcaaccagctgactcttgaatgggataaggaagtgttggccaacaataaaagtgtcaccactggctagaggtctctggttattcctagagaagaggcagccctagcaacctcttatccagtttaatggctctcacccacatacctgctgcatcccacatccccctccaacagtgggaaagatgggcagagagagagagagagagagtgtgtgtgtgtgtgtgtgtgtgtgtgtgtgtgtgtgtgtgtagtgtgtgagagtgaagcctttgggcttggggacctggaggataaatgctttgaggataaatgtgaggttcaaaagtccggcactggccaggcacaatggcttatgcctgtaatcccagcactttgggaggccaaggcatgatgattgcttgaagccaagagttcaagaccagcctgggcaatgtagcaagactctatgtctacaaaacattttcaaaattagccaggtgtggtaacacgtctgtagtcctatttttactcaggaggctgaggtgggaggatcgcttgaacccatgagtttgtggccacagtgagccatgatcataccactgcactacagcctgggcaacagttgttgtttcaaaacaacaacaaaaaaggctggcactgtgaatgtcaggtgaatgtgagtggcactcacagctggcacgggaatgtcactactcacagtgcattctattgctggagatgcagaattaggctcaacccagaccgatggaatcactctacattttaacaagatccttgggttatttacatacacattaaagttttggaggcattgatttaaaatacattaaaaatagtacaaaattattaaagtaggaaaaaaagtgtatctcttgactatctaaaagtatctcaaataccacaaactagtatgtgattcactctctcacctacaggatgaaatctcaaatccttagcttggtgttcaattcatagtcacattttcccatagctatctcccactttgtcctgtattaatagcattttaggtcaaaccagcctactccttgtccactgattatgccacagtattccctcttctacacgttactgacaccattctctgtactttttagggcatctttccatctttcttcagcatattgccgcctttcccttgccctgcaccacactggactttattttcataattatgtcctgtatattctgcctcccagtaactagactttgagctccttgagggcaaagcctgtctctggagtcccagtaatgagcacagtgtgttgttgcacagggcccagtgcaacaatgagtaaatactcattgcctgagtcagaggaaggaaaggaaggtaagacgcagtgatgcgcatcacctccctagggagcagaggctgagctgcaccttgggaccagccacacaaggctagtgttcactaggggtggggtggtctgtcccctcctatgattctgcctcctaaacagcagcacctgcctgccataatactgaaaatcattaggctcaatcagtccttgggagcagagtgtgtgtgtgtgtgcgtgcgcgcgcatgtggtgtgtgttaatgaccagttggttgtttgaaatatcctcctcggcaattctatttttgtttacatttaaacaaacaaacaaaaagcatgtcagtgtcacacaggtgtcagtgtctgacttcacgtgtcagcaactgcaagctttccaaagggtctcactcgaggggtggtgctcaggaaagcctggtcactattatttcaagtcagcaatgtgccccatcatttctttttttttttctttctttctttctttcttttttttttttttgagacaaagtctcgctcttgtcccccaggctagagtgcaatggcgcgatcttggctcactgcaacctccgcctcccgggttcaagcaattctcctgcctcagcctcccgagtagctaggattacaggcatgtgccaccacgcccagctaattttttgtatttttagtagagacagggtttctccatgttggtcaggctggtcttgaactcctggcctcaggtgatctgccggcctcggcctcccaaagtgttgggattacaggtgtgagccactgcgcccagccgatgtgcaccatcatttctatggttcatcgtggctgcggaacagtgcacttagcacccaccttggtaaagaacctagaaaattacctgagaaaattaaatagttcacacacaattgtttcaggcctcaggtctctggcattttgtttaaggtgacctcagttttggcagctgcgtttattaaattctatgtacctgtcactccaccttgtaactttaaagaattacaaatgacaatgtttttaagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggtgagttattcagagatcagctgggggagctgagaactcctccagtatggttttaggttatacacaaacccttcagtctaacaacctttgttatttttccatattaccaaagtaatacatgttaattgcaggaggtttagaaaacataggtaagtaaaataaagaaaaatgctaacatcacccataatcccatatccaccgataggcccaattaaactctgttgtgtatcttttttttttttttttttttagacaaagtctatgcccaggctggagtgcagtggcgcgatcttggctcactgcagcctccacctcccaggttcaaacgattctcgtgccttagcctcccgagtagctggattacaggctcaagccaccatgcctgactaatgttttgtattttaaatagagacagggtttcgccattttggccaggctggttttgaactcctgacctcaagtgatccgcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatagcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcattgctgttttaactccatcttttggatcacgtgtgaggtggaatttttatttgtgtttgtcattgtttttgtgaattgtgtgtttgtgtccttagcctgcttttgcatcaggaggtccattttttcccccctgtctcatgagctctttaaatggtcaggatatttgctcattggctgtcttgtatgttgatgaagctttgtcccaggtaagcatttgccttcagaccttgtatatgaaggtcatttcaatggagagagatttttattttttatttactgaagctctttagtcttcctatatggtttctagctttttggaatcatgtttagaaaatctttttcatcccactccctggcaaatgatataaacgtttatttatacttgtttttgaatcctgtattttcttttattgcctttaaatttccaagctcctgcatttattggagctacagtgcaatagggttctaattttgttttctaacaaataaatagcttgtttcagtactgttgaaaagtccaactttctcctgatgatttgaaatgattcttttattataggctaaattattatacattaaatttgtttatggtctttctcttccgtttcttgatctgtatcctgttttgattcagtgtcatattgttttaagtattgaagttttaaaacatactttaatatattatttactaaaaatttaggtattgtattgcaaaaagttcacagacacacttactggttttatttttccaggtgaaacttaagtcccttttatttaaaaaagtcattaaattttgattgagattcatttaaattaatacattaaattgaggatgaattggatttaatatattaagtattcccaaagaatttggcatatttgctattcatatagtggtaacaaggcaggagatggaagagatggaagttgagaaatcaaatatttggccacagtaatcattctaggaaattggaggaaatatcttttgaaaaaaatgttaaaactcaagcattaaaacacgaattaattagtgacaaagggtaatattatccctcagagcagtataatgtgaattttattttattctaagggccaatggggacaagatggcctatttcttactctgaaggcacatcagtgaagggagcaggtgaaactgccaggcaggccttgaaatccaaggacactcctgccgtgcatctggccttggcgacagccagacaatttggtagcttcccaggtgctcggcaaccgaaaaaaacttgggatgaggaagagagctgatgtcagcagggcatcaggaacagatggatttctgctcttccaaggaagaggctgtgccgttggatgttttcttttggggggccacatactgggacctcctacagtacagaaacctcagtgggtggaggctgagccccacacccgtggaattcgacagcgccagtctcaggcaaggagagggaatgttgattccagggaggtggcggcccatgttcagagcatcatctttggagtctacagtgtatttgaaaatgtttctgtcaaggcgaaatgagctgacattgtgagacactggcactggtggcagaggggctgtgtagggggtcaggcaataccatttctcaccatttgggcaggaaagagtccacaggctaggaagggacatttcgtcttcatttaggaattatttagacacactttggagagttgagctaaggaaatgtagcttccaaggaggaatgaagctaccactgggtccgtatggagtcctgggaagccttagtttagagtaacggttcctacttctgttttgcaaggtcctctttagtatctttctgttttttttttaagggaggtgaggcacatgttgccatctctattttacaggtaattaagttgtccatgccctcacctggtgggtgaaacaactcaaaggtcagacttaggctgggctttacggtcttcttcaagcctagaaatggagcaacccaatctccatctttttacaagatcaatttggaaaaacccaaatataggaaaaatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcagggaggcttagaaccttctagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaaaatacagaaaataggaagccttgctttttctttttcattctgatccaggattcagaggtcccggagcaaggaccttgctacaccatcatccacacacttttggtaaagaatgaaataaatagcactgttaacctggagtagtgttcccaaagaaccttttgtatttatgttttctattcaaggcaatgcattgatagaagttggtgaatccatgaagctaatggctgaggtgaaagactctcttgatattaatgtaaagcaaacttttattgatccacttcagttactacaagataaagatttaaaagagatcggggtaagtcttccagggtataaatatacctgttgctacataagatgatgtttatatttaaaatcactagaacgtttcagcagactgaaagcatcatcttatgatgcttgtgggtagggtaaaaatgactcagttctattttcctgggctcactgggaaagagtgccaggatccattagtcctatctgccctggagatgaagcaggataatgggagggaatgtaagccatgttctttcagctggaaattctgtatttagttgaagccagctctaagccaggctaaacaaagtaattacataactttatagtggatttcttattatcaaaatcgtaccatagttgcatgttttgatgcgttgccctggtggtcattattttccattacttctcaagaagatcaatacctagaaattgaatttttcatttggaaaactgttaaaaatggcgtgcatgggaattttcaggtacctggagataattgcatgccacttgcatggtggcatttttgtagatgtgcaaaaacagccccaagacttctaccccaccagtgacttccactctggaggtacaagcaccgtcttatggatatgtacagaagatgttcctccaggtgccttcagcatgatctcagcttggaggtcatttgagccttgggcatatcctgttttcccttcttcagacctattgattctcaaagtgtggtccctggaccagcaacatcagcatcacttgtgagaaatgcaaattcttgggccccatcccttatctcctgaatcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccatatgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatagggtgtgtaggggtgggggtgcaatgaagggaggaaaggctgagagtcacggaaagccctggatgcctgtccaggcaatgtatttagaatttctgctgaaagcaaagggtatgagggagaattcaggaagtttgagtgagaaatgaaagcatccattcaggagctccctaaacatcccattccccacctgcacaccccttggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatatagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtgtcatgagcaccgttgcttaccttttgctcatgttgggcagtccattcctcggggtgagtgatcgtggtttgttccttgtagtcacaagcctcccacgtggtttgtgctcacacattattttatttttttaattttaatttttgtgggtacgtagtaggtgtatatgttggtggggtacaggagatgtttttgcaaattatttttgaatggttgattctagagaagtgacagtctgggttctggggatgccaaaacatctcccccaaatgcacagttgtaaaaccaaatgcctcctttgctgacatatagcaagttttatttcttcttgtgctgtcatcatggaggaaggtcatatgaaaagtcagcattgctcctccacctggccaaccacagacacatatgtggtcctgagtagtaagtgggtgaaatgtgtaaaacacacttattctgaaatgttgcagttctctatgcaacaaaatagttttctaaatgccatcttgttactcagctgctgtttgatacagaactgtaaatctaaacttaaattatgtggatgatggaaagttaagagtccaaggtttaggaagcctttcatagtctcagctatgctctgtgtcgctcagaaatcaggggtcaggggcctgttcatttgacatacggctgactttcaggtgttcatgtagaggtacagagggattagggaccagcccaaagtcacagagcaaagagagagatgtttctgactctctgggtcttgtgtgctcttttcactgagtcatggaagttagaagcagtgcttcctgctaaaatgaatagtgcgagctatccccatgcttcagtgggatgatcagtttctacatacactttcgatgcctggtatctgatttccgaggattatagccataaactctccagggacccctcccttgtcctgtatagctatcccactcagcactgtttctgacacggggtctctctgcttggacacaaactgtgatgggaaacctactgctacgcaaggcagcctgttccatgagtggacagttctaactgttatattttgttaaagcggttataatattgtttagaaattttactgtttcagaggttgtctgtgaatctctctcctttgcattcattaacagcgttttacgcaacttatttcttgattgtttgggaactttacggagatccgttaatattctaagggattgtagaagtttgtgattttatagtctactacttagtcaggagttgacaatagtaccaaaagaaatgttcctactgtgttttgtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtttgtgttgggccacattcagagccatcctgggccacatgtggcttgtgggccacaggttggacaaacttgctctaaagccttagttgttatgcaagtttctagaattttctcctatctcctgcctgagagattgattgcttcagacatccagcaagccctgactcacatctttttttggagacagggtctcactctgttgcccaggctggagtgcagtggcacgattgtgactcactgcagcctcgacctcccaggctcaagcgatcttcccacctcagcctcctggatagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctggagaatttattctcccaactggaaatgccaatttgaaatttcccatgcccattaaaccactgaggcctgaaaagtacactctactgtgtttcttcttttaatttttttttttttttacattttttttgggaaataggaggaggtgtgacagtttggtatctctgtttttctttaaatgtataaatttcctcttgaaattgtccccaagcaacagcgattttgttttgtttcagattgccgtattgttttgaagtctttagaaaatgtatttgaagtgtgacatgtatcagatactccttgttgggccatatggaatgttgccctgctggctccaggcccattcatggcttaaactctgagattgtgtcttgtgtgtcagatgcgccgtctgacccatttgttccattcactgccttcatgcgggaaccacaatgatgggtttttgcgaagtgctccatgagggaagcctgtctgagccacgccggccttagcagttgacccaagagacctcagttttccccctcagtatcagtcaaaagtcaaaaaggatcccttcattataaaagctcaatcatttgtccatgttttgacagtaacacgtattctgcctgtcacaaatgggttaagtcctcccaccctgccccagcagaagtaagagctggttcctagcccaagctccgcaggggctctggtgctggccttgctccggcctggttgcagtgtttcctccaaggcttcctgtgggaaattgacctgcaggtgagtggaggtttcccctgttcagctctggggagtcagggctgctccctcagcctggatcctggggtcttcaccttcacaaggaggggttgtctggcttctacttctgccattgaggtgggaggagaccaacgttatgaaacggagatgggccgcccaggctgcccgggaactaggctcttccctccttcctgcttcctgcttcctgccatctgtagctgcaatggctgctaggtgtgctctggctgctgcttcttgcggtaatggtggtgatcgtgataatgataaagacagtggtgataatgatgatgacaatgacaagagctaccattcactgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctataggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagtgagtccaggcacctgcagtactggctgtcttggtatacattcaccagctacgggatcctccttccattcatgggttcccaagaccagtggaattactagattccagattcctgaggtctttccattggtctagagtagcattttccaaaatccattccatgggatgttagtgtgttttgcattaataatgtctctgtggtcacataagtttgggaaaccctgggttaaataaaactaaacagtttctttatcacaagacttttcagagtctttatttgacagtatgaaagattaatctctaagcggttcctaacagaaaatacagttggcagtttaccaaacttatttgaccgcagaattccgtcacattattatattattactaatgtttcaggactgtaatgtgtggaataagatgcattaggaagtattgaacttgtagaaagcatacccagcaaggcgtgagatacctgaattctgtttctgattttgtttctgctaagcctctgggaaaatcatttcacctgactggtatcaggcaaattaacaactgcatttgagaaattctttagaaggataaagtggagaataaaagtgtaagggattattatccatgttattaatttaattgccttactcaaactttctcagaaactctgaataaaggcttttgccccattggaaaagtcatctgtttatgaccagactgcaaaatacatgagaaattttccacagcttctctgaggaatccaaaaagagtagaggtctttgatatgatagagcaagaaattactggtattattacactgtaaattgaaggtgacctctatgggaaatgtgccttttcagttgtgaaagagaatggcttgtcgtcttttgaagatgtacacttctttattcctgcatgccaaacacacttgcagaccccaggcgtctggacaggcatcagctactcacatcacagttctctctctgtcctcgccatgggcttcagggtgtgctactctctgcttactcacccggctgctcaccaagtcccctggtaagggattgctaaagggtcagaggaggagggttcccagccctgctccttctaggcaccccagtttccatagtcctcttgcagagttggcctaagacagccttggttacagtatgcagtcctttgagccattcttcctttgggtacagcctaagccttttgcagttggctcacaaggccaggccaatggctcagatcttatgcaagtgtccctggggtttccataactcctagaaacttctagtatccttagtccattgtagttggggacatctattctctgtttccatccccaggactaagatactcccaacggccatatatgctgctaatcatccattggtttccagctatagagaggtttggaatgaaatgcatccacaggtgacacacgtgtgtcacttgtggattgtttattgtgtatagtctgccatgggagataaattgagttaattcctgttttggggttatccctcagaagagagtgaggagccctgggatacagccaaaccaacaatgaagtccccaggcccagccacgatgggcccattaccccctgagcttggttcttatgcgtctccaggcaacaactcccatcaccatgaatgggggtccctgggcagcactaatctcattgttaggtttttgcatagtttgaggatgggctaaagcagctctgtatcagtttcctattggggccataacaaatgaccacaaactgtagcttaaagcaacacacatttattgtcttccagcctagagtcctaaaatcaaggtgtgggtagggccatgtttgttctggaggctcttgaggaagaagctgcttctttgccttttccagcttctacaggccacctgcatttcttggctcattcttcgcttcctccctcttcacagccagcggcacagcatcttcacgtatctcattctgacctctgcttccattgtcatatcttctctgaccttggcactcctgtctcccccttaaaggacctcgtgattacattgagccattcagacgttccaaaataatctcttcatgttaagatccttaactcaatcataaccgcaaagtcccttttgctatgtaaagtaacatatttgcaggtttggggaattaatatttggacatctttgcaggttccatgattctgtctacctcaggccccctctggttttatggttctgtgtgtctcccaagttgcttcttcacagccctcacttcacacatttgtcaaccaccgaggcctgtgcctccttgacctctaacctacatggaagtcagcttgcattatgagtttctcacttcaaacatcagctgagtgtgagcccatctgtaggagctagagtgcttcactttcagaaaagggagtggattctctggaaatccagttccttggcgtatatcacgtgaacattttcatgggtgaggtcacactttgctctcaagatggcaccagcacagtgtcagcccaggtctcaacccggaagtggaattaaacctttcttcccaccccaggtgactttctctgattcaacagatggactgctgaaattccaacaatggaagaaatgttttaccttttggtcaggttttggctcttgctaagcctgagtttgttgctttatcttggttctgcctgtctaggtatttatttctaatcgtggttcaggaagctgaatgtacctgtgttggtccccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctttagctctatgtttcagggaaaatatgttgagtggatagcaacaaaacgcatagaggggacagggaaatctttgccccagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacaggattatggtaatgcataaatttggagggatttttacttaaatcaatgacgtagttacctagggaagacaaagatgtgttcagtccctgaagcatccacttctgcaggcagatagtttacctgttactgacaggagtgtattttcataattctatcataatctataagagtagagtgagggagaaggcagctcccatcactgggtgccgaccgcgtcccaggcacttgctggatgcctcagagacttgatgaagaaaattagtcttttgttttgttttgttttgttttgagatggagtcgtgctctgttgcccaggctggagtgcagtggcgccatcttggctcaccgtaacctctgctcactgcagcctccaccttccagtttcaagagattctcctgcctaagcctcccgagtagctgggattacaggcgcccaccaccatgcctggctaatttttgtatttttcgtagagatggggtttcaccatgttggccaggctgatctcgaactcctgacctcaggtgagcaccttggcctcccaaagtgctgggattacaggcatgagccaccatggctggcccaattagtcttcttcaagatgaatttcactcacaagctcaaatagggagttgaaaaactgcatttgtgatatcacctccatcacttcgggctactcaagagtcagtgtgtaaaaatcgtccctttcatgaccactggctgtaacctaagttcctgtgctcaacaaggcagagaggatgtgtgtttggaaagctttcaacatcagatgtctggctcatcttacgatgtgtgttacagaatatcagctgcatccagtgtccccagacgagaatacaagccaaggcctgtgaaaaggagttctagtgagctcaatggagtttccaccacctctgtagtgaagacgacaggtaagttgaccattctaatatgctaagtgtgcctttagtaaagcacttctagaaacacttatttactgcttgtttctgggtcagtgaatacacacagaccctggatatctttctttggttgtttggtaaattcccttttcccctaaacgtgccccttttttctgttccctggggaagaattctatcacttatataatgtagcatttagaaccttggccatagaaccattatggctacatcatcctttatttttttaactctttgaaaatattttcttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacataaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctgggattataggcatgagccactgtacccagccttttttctgttttttaaatgcgagattatactaggcatattgtttggcagtttgctttttaaaatgtatcactgtttcttcgagttatttccatatcatgcatatagatctatcccactgttttaacagcttcatagttttctattataccatttccctattggtggacgttaaggttttttccagttatttgctacagtgagtatcctttatcactgtgctggctacattactattaaagcatgaacacctgcttccccacacccatgccagtagacttccatttctgccaagcactcatgagaaaaaaatggtatccagtcttaatttgcattttcatgattattagtgagggtgaactttcttttctatattttaatttgtatttccttatgtctgaattgtctgtttatgtcatttatttgtgttttttgggagtagtttgctttgtcttattgttttataggagctctttccatatgaggatattaataatttttttcctagtttgtcatttatctttaaactttgtttttggagtgccttgtccctttgttgtttttgctgttgtttgctttgtttagttttgctttgagtatacagaagcttttattttgatgtagtcaaatgtgtctgtcttttgcttgtgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagctgcacagtgtgaattttcttccaaccttatggctatccttaaaggtttttttttttcatttaaaaacaaaaattatcagagtaatatgtgtatgtagtttaaaaagaaaatggtaatatacgtatgtggttttaaaaaggcaaatgtagttacctctacctctgtgtgaaaacatgggcaggccccatgaattttctcattattaaaactacaaattatcagagtatatgtgtatacatttttttattttttattttatttatttttatttttttgagacaaagtcttgctctgtcacccaggctggagtgcagtggcgccatctcggctcactgcaagctccgcctcctgggttcaggccattctcctgcctcggccccccgagtagctgagactacaggcgcccgataccgtgcctggctaattttttgtatttttaatagggacggggtttcactgcggtgttgatctcctgaccttgtgatccgcccgccttggcctcccaaagtgctgggattacagctgtgagccaccaggccgggccatgtgtatacatttttaaaaaaaacatggtgcaagctttttcgtgagaaatggcagtttccccatcaactcctttcccagtgcttattttctgctctcagaggaaacactttcaactcttttacatatttatttggtacttaacttcatggtgcttgttttttactatttctttttttactctgattcttcagtttggataaatgtattgatttcctgatatggaagataatggcttagcttcctaacccttggtcttccatagacttctccctcccttcacccttccaatttacttataatcactatttttgttaaataaatattcattgtgtaatcatcacttccatcatgtgggactcttaaaatgcactcctccccttttttccctgctcttattttaaattgcctactcacggatgaaaatgtgagcaggctgcatgacttttctgactactcttgggtcacataagttctccagtcacttgaatgtgtaagtgcaggctcgtgcagtagtcaaaatgctaagacccatgtcatggtcaaagctataatcttgatttaaagtttggctttcactcctccccaagctctggcctgttgccgtgggaacattggtgtcagggaagaggttgtatttggctttttctctttccccatctaccccttctgttcttaagtccccagagaatgtattttaagctcgctgaggaatcttttaaaagttcttctctcttgatttggtgtgaaatgaaaagatcacaacacatcctgcctcctccacactctctccaacatttttctaaaaatcctttttaatctccatcttctgacctatttatgccatagatgtaggctgggattaaaagttataaaactggctaccctcatctcttctgtttttgtttgtttccaaatcctgcataagttgtcttctgcacatcggtttaataaaaaagaacaaacaaaaaaaaaacagttctggggcctcatccaaaacttccatttttacatcgcctaacacttatttacaatgtcatgagcacagaaataatattcacagcagtatcacatagtgcactatcattgcatttctattcttgtacaattgttgtcttgatgactgtagctttataagttttgaggtcaggccctgttagtcctctaactttggtcttcattttaaaagttgtttgactattctagttactttgcattttcatgtgagttttagagatcaaattttcaatgtttcaaaaaaatcctgctcagatttttatttggattgggttgaatctataactcaatttaagaggaattgatagcttaacaatattgagtgttccaggcttgaacacaatctattgtatttcccatttatttaggtcttcttgaatttctctcagcagtgtttcactatttttagaatatatacaggtcttttaaattttttcatcaatctctaagtattttatatctttatgcaattgcaaacagcattttaataaaatttccatttctgaatttttgtttctagcattcataatattccattgatttttgtatattgatcttgtatcctgccatgttgctaaatttacatcttaggtctagtagttttttaatagattccatagtttttctacatagatgttcacgtcatctataaatgaagacagttttactcaatatctgcatgcctttgtttttcttgccttttttcacttgctagaacatgctgagtacaaagggttagagtggacatccttgctttgtctctgattttaggggagaagcattcaatacttcataattaaggatgattttagctgtagatttttcatagattttttttttttctttttgagacagggtcttgccctgttgcccaggctggagtgcagtggcgcagtcgcagcttgttgcaacctcaacctgccaggctcaaaagatcctcccacgttagcctcccacatagctgggactataggcacacaccaccaagcctggctaatttttgtatctttcgtagagatgaggattcaccctgttgcctaagctggtcatgaacttctgggctcaagctattcgcctgcttcggccttccaaagtgttgggattacaggcatgagccactaggcctggccttcatagattttaaaaatcagattgagagagttcccttctagtcataaatagtttgaagagagttttaatgagaaacagtctttgaattttgtcagatgcctttttttggtatctgttgagatgatcgtttattttttagttttagtttgttaatatggtgaattacattgttagttaaatcaaccttgcatccctaggataaactctttgtgggaaagtttttttaaattaattttaaattttagaatagttttagacttacagaaaagttgtgacgatagcacagggcattcccatatactcctccactcttctatattaacattttattagtatggcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgggaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcaatttctcagacaacttaaagcagaactatcatttgacccagcattcccgttaccgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgtttttttttttttttcctgcatgaaggctttaagctataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatttccacatatgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagagggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccactgatttatttatttattttttttactatcttaaatatccttctcctctattccctttctttttgcccttgtaaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccacacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatctcggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtctactttatgaagttgtttctcatacattgatgattcttggctctgtgcacaactttttatttgagagtgcttatgaggttgcctcctgtggttaaggggaaataagggatgttctgttgagtgcagtggactggtttctgtttttctgattgtttctatcatccatggcactgccctgactttctgtttcagatgcccacactcactcagtaccccttcctgaaggcagttgccagggctcctggcactggtacaaacccaggatgagtggactcacctggctgctcttttctcagaaagccagccagctttcaggatccacttacactgagttttgagcgcccttagacttcactgtcacagcattccgctttgggagccattttgaacctcatttcctccatctgctgctttccatcttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtattctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattccacccaggttgctgcagatgccattagttcatttctttttatggttgagtagtattctaccacatatatataccacagtttttttatccactcattgatgggcatttgggctggtcccatatttttgcaattgcaaattttgctgctataaacatgcgtgtgcaagtatcttttttgtataatgacttctttttcctctgggtagatacccagtagtgggattgctggatcaatggtagttccacttttagttctttaaggaatctccacacagttttccatagtggttgtactagtttacattcttaccagcagtgtagaaatgttcccttttcacccatccacgccaacatctattttttttaatattttgattattgccattcttgcaggggtaagttgatatcgcattgtggttttgatttgcatttcccggatcattagtgatgttgagcatttttttcatgtttgttggccatttgtatatcttcttttgagaattgtctattcatgtcgttagcccacttttagatgggattgtttgttttttttcttgctaagttgtttgagttccttgtagattctggatattagtcctttgtcagatgtatagattgtgaagattttctcccactctgtgggttgtctgtacactctgactgttccttttgctctgcaaaagctctttagtttaattaagtcccagctatttatctttatttttgttccatttgcttttgggttcttggtcatgaagtctttgcctaagccaatgtctagaagagtttttccaatgttatcttctagaatttttatagtttcaggtcttagatttaagtccttgatccacgttgagttgatttttgtataaggtgagagatgaggatccagtttcattctcctacacatagcttgccaattatcccaacaccatttgttgaatagggtgtcctttccccactttatgctttcgtttgctttgtcgaagatcagttggctgtacgtatttggctttatttctgggttctctgttctgttccattggtctatgtgcctatttttataacagtaccatgctgttttggtgactgtggccttatagtatagtttgaaatcaggtaatgtgatgcctccagatttgttctttttggttagttttgctttggctatgtgggctcttttttggtttcatatgaattttaggattgttttttctagttttgtgaagaatgatggtggtattttgatgatgggaattgcactgaatttgtagactgcttttggcagtatggttatcttcacaatattgattctgcccatccaagagcatgggatgtgtttccatttgtttgtgacatctgtgatttctttcagcagtattttgtagttttccttgtagaggtcttttacctttttggttaggtatatttctaagtttttgttttgcagctattataaaaggggttgagttcttgatttgattctcagcttggtctctgttggtatatagcagagctactgatttatgtacattaattttgtatcctgaaactttgctgaattcatttatcagttctaggagctttttggaggagtctttagggttctagggttttctaggtatacaattatatcatcagcaaacagtgacagtttgacttcctctataccgatttggatgccctttatttctttctcttgtctgattgctttggctagaacttccagtactatattgaatagaagtggtgagagtgggcatccttgtcttgttccagttctcagcggaaatgctttcaacttttgtcgattcagtattatgttggctgtgggtttttcatagatggtttttattacattgaggtatgtcccttgtatgccgattttgctgagggttttaatcacgaagggatgctggattctgcaaatgctttttctgtgtctattgagatgatcgtgtaatttttgtttttaattctgtttatgtggtgtatcacatatattgacttgcgtatgttaaaccatccctgcatccctggtataaaacccacttgattgtggtggattatctttttgatatgctattggattcatttagctagtatattgtcaaggatttttgcatctatgttcatcagggatattggtctgtagttttcttttttttctatgtcccttcctggttttggtattaaggtgatactgacttcatagaatgatttagggaggattccctctttctgtatcttgtagaatagtgtcaataggattggtaccgattcttctttgaatgtctgatagaattcagctgtgaatccatgtggtcctggacttttttttttttggtaattttaaaattaccatttcagtcttgctgcttgttattggtctgttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgcaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctcccacaggtcccttttataagggcacaaatcctactcatgacctaattacccccaagtcactaattctcatgacctaatcacctcctaaaggtcccagcccttaatactattgcattggagattaagtttcaacagatgagttttgggggaacacacacattcaggccatagcaaataggaaatacactgcatgtaccagtccataacaatgatggactcctgctgggcagaaatttcaaggaccccctaccctggcagtgaagaaagtgtcttgattagaccctggttctgctctctggattttggatcagggagactcttttgtcttttattctgtgggctcctagatttgctctctgagaaatgtgtcttccaagaccacattgtaagtgggctttggagggctaccttctttgacatctgtacttattgctgctcagggaccttgtgggttccttacagtttagtagacacagatgtcttcaggctaggcttatgcttcttttcacaacttgatttccttttttttttgagatagtcttgccctgttgcccaggctggagtgcagtggtgggatctcggcccactgcaacctccgcttcccaggttcaagcaattcttgtgcctcactctcctaagtagctgagattataggcatgcaccaccacgcctggccaatttttgtatttttagtagagatggggcttcaccatgttggccaggctggtcttgaactcctgaccttgagtgatccacctgcctcagcctcccaaactgctgtcaccacactggccacaacttgatttcttaaaaaacgtaatgagcttctgatctatatacctccaggcagttccatgtgcctgtaaacacattcaaagttctttcttagatatagctcttaagactttcatttctttccttccttgtcttacccatgcttcgctttcttaacttacagaggctaccttgagaccacctgaaacagcagatttgagtaggaaggtgacacctttcgttgcgtctttgccacacagctgagttcctttagtttagggaggtctctgagaatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggcttacgcctgtaatcccagcactttgggaggccgaggcgggtggatcacctgagttcaggagtttgagaccagcctgaccaacatggagaaaccccatctctactaaaaatacaaaattagctgggcatggtggcgcatgcctgtaatcctagctacttgggaggctgaggcaggagaatcccttgaaacccgggaggcagaggttgcggtgaggttgtggtgagccgagatcgcaccattgcactccaggctgggcaacaagagtgaaactctgtctaaaaagaaaaaaaaaaagaagctaggtataagcaaattaactaaaaattttgacagtgagttcaacctcagcctccctccttcaatgccagtatattatatttgaggaaatgagaacccaggaccccagggctcagtccttgccccactgtctctatctttccagcttgcacccgagtagttcttagagacaggacctcaggtcaagctcccaagacaccattctctcatttgccaccaaagagaactcaactttcctttgatttgagctcacagactggcagtgtagagagtgttaagccttataaaaatgaaaaggtatttgaattaaagtatcccttaaggtcatagggacctagcctttgagggccaacagtatgccaggagttattatttggtgctttgtagacatagacataactcatttcatcctcataaccgtactccaaggaagtgataataaaaaaaagtaacacataataagataatgacaatagcaactacacttattggctacttactatgggttagatattgtataaatactttgtatacatctctagtactatttttagtccccattttacagatgagtaagtagaggctctgagaggttaagtgagatcttctcaagatcacagagccaggaagtagcagagctgggtactttaccttatagatatttcatgttatatcattaagaaggaatactaggggaatgttatgaaatggccaagagcattgggaatgatttatttccaagattcatgattacagggaatctgtggtcagcaggtggttgcacagggagcccactaaatgcatctgacttggaagggaaaaacagaggacagtgaggtctttggcttcctcattgaggccacgcatgtcagtgctttgtcccctctttcttggccagtagctgggtccctagacagattaagttcctagaagggcgatgtacagagatcacagacgtgcagaagctggcttttaagaaggctcagtgtcccatattctccactgcagcaaactctactgtgtgccactgtgtgtcttttgcctgtgcctgtcccaggctgcttcttctaagtttccctcggtagtagcttcaagttcccgtctcacacacccagcattgggcttccttgatttgtgggtggaatttgccagtgtaaagggggtcctgtactgtttgtttctgaggcacagtttcaaaagaaaatgacatttatagcctgcattaatgggaaattactttccattaggattctgaatgatttgcacataatgtttataaagtgaaggaaaaatgtcaagcatttcactaacaaatgaaagcaaagctcatgagactctgccagaaatgaattccaagaacattttcttcatcatttcttctttctaaagaaaaaaagagagagatgaaagaacataagtcaattaagcagaatgcatcgtgggactgagatggaatctttgataatatcattgctaggtagttaagagaatgaataaagtgagccaaaatggagaaaggggagaatcacatcttgaaatgacagattgcagacaaaatccaactctaggtcctggctgggagaaacgagtgcctgtccaagcccgcgagtgtggggtcatgctgtttcatcagtgtaagctgcccctctgtccccaaagagaaaaggaggccaggaaacatccttgagttgaaacatgtgcctgtgtagctcccagaaaaccactgatgttgaagaaaatagtgtaggaatttgtgacccatgctcaagtatcttccccacttgtggggaatttgtatcaggtcccaggttgtcacctcctgaattatatatttaaagactagaggacaaagtgtattttatcaactcattttttatgaagtttttttttttcttgctgaaactcttaaaaggggtaccactttgtgtaatcacaactaagggttaatatgccccaaactgggacctgctttaaacatataggaggctgaaattagttaacaaatatgtattccaaatgtgtgctacaggcacatcagagtgagttgaaataaatctcccaaatggcttgtattaagaccttctaattctctaggtataaaagagacttttataaatttcttcacacttctaaggcagcttggaaataatttctagagcctaaatccttcccctcattggcacaaaatgtctaggattacattagaaaataaacatttattcaaaagtgaaatgtgaagtttgaaaattaaagatgaacactttgcaaatagaaatatatgcaatttttttaacctacatttccgaagaggaaattaaaatttcacagaacagtgacaatggtgattgttcggtcagcaggttgtttcttacatttctcttctttccttcctcctcttttcttctattccccttctccactaatagccttccccccagatccatttctatatattataagtagtgcttcagagtcagagttattgacaagagagaaataaataaggaaacaagagtcccatgttatagttcagattctggaacttcttagttgtatgagttggggtgagtttcttagcacctctagaccgatttgaacttgttcctagaggaagtgattggacttaatacattccaaggtactttctagctctaaattctgtggctgtagtagttgtcttttgtgagtacttagcattcttaataatttgaaatgtggacaggttgaacatttaaatattttctatattttaaaaaatgttttaaaaattaaagtgtgaaatatgattattattgttgatcagtagccattggtgcggtgaacaggaagagtctctctcttattttccaatttgaaggaagatttagagagggaagttttcctcactgcagggaatggttttctgtaattattctgaacagtctgtaaaaagagttttgaaaagccgtaagacataaattctaacttagttgtgggaattttgactttgctgaaatgatctcaagtgctgcatattttcaaatcttaacatatactctataatgatacatttgatccataagctaaaatgtaaaataccatcatctaaatattaatttatgtacttgttttaaaaaatacggtagaagtcagttgtttcctgggattacaaaccaggcaacagtgatgttgcaccatccagaggactctgagtccatatgaatgacagcccctagagttgtccagtggatgtggctgcaagtgcaaacttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaatttcaataaatcacatctcctgtggataaatacagggctgttatttctagaaagacagcagttcattgacttttactagattttacttagtagtgcacaacttaaccctcatagaccaacacttcaaatttccagataaggaaatcaggacccaaagatgacctaatccatagcaaagatgcagggatctgaagcttctgtccagtgcgctcttacccatggacaaaaacaatatgttagagatgttgaactagatagtgtctgtggtatctatcagcattagacaccagtgttgtatctgggtcagatagagagaaagtatgtgcttcaaatgaattctgctataagaatttgagattataaatgggaaaaaagaaacttttgaagggagtttaaaccagatatgcttgtttgaactcagaggagatggtatctcacagattgagcacggtgcctggctccatgctcctggctccatgctttcaaacactcggtgagagtttgaaaatgaattggaaccagaaataaacctgaaagttccaaattgggtttctacccgccccccactccccccgcccgcccatggtaggagatgaactgtctagtctgatggtgcaggtacagtcaaacctcagggtaacctgggttctgggatcgaagcttctaggagacttggggtcccattcctgactggggcatggactcccctcatcaatggttaccttcctctctgttcatcagctgctctacaagtggtgtaagtaataagggaacatgtttggatttcctgacttcaggccaggaagtgagcggaatataagcccacccagcccaaaggggtgttaacctgccttgctggaaagtgggctttggagtcagagggaagcccagatcctggctcagttcatacctttgggtctcaatttcgtcatctgacgagtgcggattctcattgctacctcacaggattattctaaggattaaattagatcttgtgaattaggggtgctgggaaagggactcggtacagagtaggagcccacaatgcagcgctgttaatgttacataatcggttatctgatttcccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacatagtgagaccccacctctatagaaaataccaaaattatccgggcatgatggtgcctgtagtcccaggtactcaggaggctaaggtggaaggattgcttgagcccaggaggtcaaggctgcaggccaatagcagggcactgtactgcagctcgaggaacagagcaagacagtctcaaaaaagaaaaaaggaaaaggaaaagagaaaagaaagaaaaagaaaaagagtggggataagaccacaaactaacaattttcagggggtatattgcatagggatcaagaacgtggactctctacctggcccgaggtcaagtctcagtgttgtggcttaattgtgttaaatttgtgtcctcaatttctccatccctcacattgggggaaatagtggtacctactcataggatttctctgggaattaaatccataaatccactaatatctctgagacacttaaaatattgtcctggcacatggtaaacactaacacctgagagttattatttcgtccctgtagctgagtagggctgaggaattgtaggattggaccgcctctaccttaataaaatgtgctcagcatttctgcatatgcaagtaaccctttgcagcagcagggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggtgccagctactgaatgtgagagagcaaggaggtggaggtggatgaggaactgccagctgcaggaccacaggggcaaggggaaggggttgtcaacagggatgggacgctgggtaggatcagtcttttcttacgagacgttttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccactgggctccagcccccgtgttagtccagagaactttgacagctgccttctcccgggatttctgtggaaagtggagtctaagacccccttccccagggtggcatccaaggagcatttcaattttcttgctcaccctcttctcactgcaggccccttccctgcttccctgcctccagaaagagcttgtatctcttctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttctgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagcaaggtagctgatggcctagggtctggagccctcctgtttctggctcagccagtagccctggggccaggccattatgacctctcagaggcattgatggcttctcttggaaaaggagaggactcatggaggactgccaaattccattctagcattaacattctgtgttcaaggaaatgcttcccgagactaccatgtggtttggcacctgaccccttctctgttaaaaactagtctagtagtgggagaaatgctaaaagaataataattatttttataatccacattaaaacagttatacattaataaagtagactttgactcacagctcaggttgcccttggttttcagtgctcagcccccacctgcccacccatatacacactccatgacccaaggaaaatgaaaagttctgtattgtaagccctctattccccatgctttgtttgaaatcattgaatgttgttctgttcaaattcaaaatagtgaactaatccccaatatttacagccttccaccccctagctttcatcattatgacaagaggaatacacagacttaggcaggggtggggtctgtcacggaaggagctgtctagaggctagaaacatcatgtagatcatagaggttatattgcaggtgggttcagagtttcaaagtcacgacccagtacaggagctgcctccctgaagaggaagaagagctcccctaccattacccccttctctttcctcgccagctgagtctctttaacctttaacgcttccttaggggaaggagaggggaggatcatttcactggtggttgtcaacctaccctggacataggaaggacctgagaaacaaaaaatactgatgccgggttcaccctgggcagtgggctgtttagtgtgccaccaagttgagaaccactgccataggaaggcaacaggaagccaccttggtacaacctggggagctccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtacctattctctttacttggacctagaagacttagtggagaaagaacataatctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgaactagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatgactgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttgggaataatgtttgtaccagaaatgacagataaagggtaaatatgtgtagtataaagggacttctaaacatcttaagaaaaatagtgatattaggttggtgcaaaagtaattgcaggttttgccactaaaagtaatggtaaaaattgtgattgctttttttttttttttttttgagatggagtcttgctctgtcccccaggctggagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatattttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattagttgaagaaatgttacattgtgagagctgacagctagtcagtaactaaaattgaaagatattcaccctagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctcccggcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttgggaggctgaggcacgaaaatttcttgaacctgggaggcagaggttacagtaagccaggatcgcaccattgcactccagcctgggcaacagagcaagactctgtctcaaaaatagataaataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaa

SEQ ID NO: 39 - DNA, 545820 bp, Homo sapiens
gctcccgggacccggagcggatcgactggcgggcgccgcgccgaggcaccaccgggcgccgagttcctggcggctcgcacggtaagcggcgcggcgccgcaaagtagactttgtggggtttctgacagccgggagaccccacctcgagcgggggctgctggtgcgttctcgcgtcgggctgcgtcccctggagctccggctctgtgtccgcgggatgcgggcgcacggaggggcagggagggaggcaaggagccgcgcaccacggtgtctccccaggctgccgctgccggggccctgggccggtccctgggacagacagatcggcgtgcgggggccgtctgccgggcccgggagccgggggcgcgcaagactgtggatcctaagactgcctccacccagcgcccggcccggggaagagcttgcgggaaaccaggaaccgcagcggccggacctctgctctgcgccggctcctaggacctgccttaggtccccagacccctcatgacctgttgccttgggtttgggaggtcaggtttgtcatgccatttccgatttccagtcatcctgggggcaggatgaaatttcagagtggtttcctggccaagctagaagcagagaatagctatggatacagcacctcgtgtatctatccagcacttacttggctttttctgagtgccaggaactgtgccaagccctagcagcatgaagaatggcctttggggagcttctggggctaagagggacagtaggaggagcaattgcagtgcagggtagtgcggaagactcgagatggagaagaggacggtgaggaagccaggaaggtttcagagaggaggtgagcattgactggaagtcggaggttttgccaggctgaaaagtgtgttgggactgtgagttgatagggagcaggaattccaggtgggttttcttgtgtaaaggtaaagaaactgaaaaggtccggtgtcctgacctagcacatcagataattctacagcagataatggagtaggaccgggtcttgctgtaggtaggaaatgagctctcgacatggcaggaagctaaaacctgcacagaccttaaagtgcagccttagaatatttagaattttatcctggaatgaaggagggccgtggaagaattctgatcagtgatcaggtccctctggcagctctggggacaatggatggaggccggagcatcagaaagctggtaagttgtagttgttttctggtccttggctgcaaatactcttccctgcttaagggagccccctctgcccgggagccctgctccctggcttctggacatggattcaggcaaagagatgctgcccgtgtaatgcttgcttctgcagcctgcacatcattttgatattgtttctggagcctgtgacctcagtcttgtcatcaggcctctgaagggtgcctctgctcttcttttctcatcttcaagccctctgtgtgcccttcccctctgcctgggctcccctttctgtttcacagagatccagtctcagccattggaggcaaggctgtgtgtagattggtgtagtagaaagaacaagggctcgctgggaaatcagaccagaaagtcactttagccataggctttggggacattagcaaccttcatgaaccttctttttctgatttaaaaggaaatcattgtactcacctgtcatggtttgggttccctggaaaaagacttggcgcttctgagatttttgtgcagataagggaagcagaactgggcagagggagatgttgatctatggtgcagtgcaagagaggtctcaatccctcccatgagacaaagagacgaggcctttgaagcttaatgttgatcagccagtgggtgcaggctggtcctagggagggagctaggatgtcccttcagcaggacagttcctgactagggactcacctgggagctggggtaaccaacactctggcagctggacatggggaagtcatgagtgtcttggtcttggagggggagttgagcatttccccacggtatccactacactacctcacaaatgaagtagtgctttgtactgtgcctggtgcatagtagatatcttaaaagtattcatttctctcacctttaagtttcatgactgcacctgaaaatgagttttggaattcgagttgagtcagcttttgtgaggagcttttaataataatagccacgaagactactgcttcccttttttgagtgtctattatgtatatacattctcttctagttgtccaataatactccaacttaggtacttttattctcattttatagtaaacccagtctcttccaaaacccaaccaagttgatgttcttttgccacaaaataataattataataataacaatcactcacaactctatgatttgttacactttccaaagtgctttcattggtggattgattgattaatcattcattcatccactaattaatcaatcaatgtgtattgagtgtctcttaaggagtaggcgctatcctaggtgatggggagaaagctcagtctattagaggagatagacattaaatgcttggattcatcaaaagcaagtgttgaggggtggaacattgcattgcatagccagtatgtgatagagaataacaggctctttgtccaattgactccttgccttcagtttcaatataaccttcttggaaaggccttctgtactccctcccttttattctcccttcgtaacagtcatttatctattttatttactttcctattgttggtcctcccctttagactgcagactccaggggatcatacattgcttcatcccaagagcctaccacagggtttagcacatatttcttaaatgagtgaaatgaatgaagggtggatgtgcttaacagtgtagtcagggaaggtctcccaaagtagtgatatttacactgagatctggggaatgagaaagatccggcaacgccaagatcaagaggcagagagaacagcttattcaaagaccgcgaggtggaggaatggaggctattgtggttggagcgcatagtgggcaaattgtgtggagtggcccgagatgagtttgaaggcagtggagtcttggaggccatgctgagcttacatttttatctaaagtgcaacaaacgaatcattgaaggattttaagcctgatgtgatagtgtatatttgtgtgttgtctgttatgcctctgggaggagaactccttgaagaaaggtgcttagtacatagtgcttaaatgaatggatgatctggtttatgttttaaaaggagtcaatctcagcttccaggtgagaagtggaatagagagaagaaagatcttgtcacagttggaagctcagtgagatatatattggtgtctgggctagaggacagcaatagtgttggagaaaagtaaaagggtttgagctctatttaggaagcaaaatggacaggacttgctgatactttaaatgcagggaatatgggaaaagggtggggatgaaggatggtggccagccttatggtttcagattggttggctactgaaagtctggcagctccatcagtaagtgactgaataaacaaaatgtagtataacatacaatagaatgttactcagccataacaaggagtgaagtactaatacatgctgcaatgtggatgaaccttaaaaatgctatgtgaaaacgtggtttaaaagccagacacaaaaggttacatagtgtatgattccctttatgtgaagcatccagaataggtcaatccatagagacagaaaacagattggtgtttgtgctgatctgagggggaagtgggactggggcttgactgcttaatggctaagtggtttccttttgaggtgatgaaaatgttttggaactagatagaggcgacagtttgtacatcatcatgaggatagtaaatgccacgcattgttagtttaaaatggctagcttttagttatgtaaatttcacctaattaaaaaaacaaacaaacaaaagttgggtggatgggagcactattcacataacagagactaggcgaggagcaggttgtgcttagaggatacaattcaaataccctcttggagatgcccgtaaaacatccacatagagacaggaattggctgtgagtctggagtcgaggaggggagtctgggctggagatataaatatggcagttgtcagcacttagatgtcagccaataaaatggatgagttcgagtgtgagagagagaggaggagaaaatcagagctttggatcattctttaatttgatctttataactattcataggagatgcgattgtcctcatttttagataaggacaccaaccccctctcccgtgtccaaacgaacttgcccaaaatcagttcgttcctgtgagtctccagacttccaatcctttgtctttcccatctcagtgtgatgccatttagaacttcggcaaacactttctctcccaaatcttttggtcatgattgagtattcacacgtggcaggcactgtccaggtttatgttagtggagaaagtagacatggctctaatctcatggagtttatccagtaaacaggaaactgcagcccacaactccaggagaccttaagatcacagagcaggggcatctatccctggtttgggggttggcgggtggttggggaaggcttccaagagatagtgatgtttaagctgaatttgtaacagaagcagagggaattagcccaagaaagagaataatccaccattgtcttcatttccccgttcctcccaggttcctggcattctccaactcatcaagagagtctatgttttctgtaactctagaggcaataagtaaataaaaggcttggtttgacttcaagcgggagcttcaaaagggtagcaaggtcgggtcccaacagcctgtctttcaaagcaaggctccatctcttgctcaactgacttatccttttttttgaaacggagtctcgctctgttgtgcccaggctggagtgcaatggcgtgatcttggctcactgcaacctccgcctcctgggttcaagtgattctcctgcctcagcctccggagtagctggaattataggcacccgccaccgcacccggctaatttttgtatttttagtggaaacggggtttcaccatgttggtcaggctggtctcgaactcctgatctcaggtgatacacccacctcggcctcccaaagtgttgggattacaggtgtgagccactgcgcccggccgactcagcctctcttaacctgactttttatacttgggatatggagccattgttcagtgcaggaaataaatgagatgatgtagcaaagtgttggatacatgaaaaatgctcagaaaaatgttatcttgtttggagaggaagactttctgagttgatcagtggttgccacactctgtacactatttataatacagctatccatgctccctttgtaggttctgatttagatgggttgaaatgaaaaatgatgatctgtatgtttagaaagcatcctggatgattctgataaaagcaagttcaggaaccattggtttagaccaaatcctctttgctctgatgagcatgaaagggttaagcacctagaagcagaattttgccttctaggaattattagccaatgacggtgctgaccgatgatgtaatgtctttggctggtgctccattggttaagtgtattgtttctcttgcttcagctatttgaggagcagagctggagcacaagggttaataattttgtggaagcagttagagctctctctctctcttttttttttttttgttcctcttctgctaggtgtgagtatacagcagggccctgcagattgttgcccttctccttccaacaaacatccacactctccttacacatccatactctcctcctttcctcctcccaaacagagcacatgtgtccgtagtactacggaggaggagaaggaggaggaggaggagaaagaagaggaggaggaggaggattctttagagaagagatttcaaagttccacactgcagtctcttactgcagtctctccttgccaccggggacgggcacagccccaggtccctctgaatgaattgctaaactgccacctgcttctgagcattgttcaacctggcagaatccttagaaccaggaggtgagcccaaggttttggaagagggagtgggcctggtgggaaggagccgtggggtgcggggaggactagctctagactgaaggtcaggtgcaagctcaagccagtggctgccgctgacttgtgatatgagcttgggcaggatggtctccctctctgggtctgtttgccaaagtgcacgatgtgaggcttggattagggccttcctaatccaagttttagcagacactgtctagggagtgtgctcaccaggagctacaaggaagcgtgttcttggtgtagctttctgtcagatactccctgaagatacacgctttcttttgggaatctgggcaggaggggagctcgtcaggttatccctgtatctctgaaaccacttctaatctggttcctccttatattgtctgagctccctctagagcactccggctcagtccagtggcccttgtagaatctgggctgaggtttctccagagactcttgaatggtctcatggattttgatcatgtcatttggggggacctttgggtccctgacccttggttgtttgtgtgccttaatgtatttgggcacttttctaggtgtcccaggctggggctcttaggggtgaggagaggaattctttttgtattatggatagtgtaactgtgattttttttttgtttgtgtttaatgggaaatggattattgcctctacctaaaacttctcaccttgtccagaaagggtcccaatgtaggcatgtgtgcctcaagatgtaaactgaaatgagtagatgtggggaagggagaggggagcagagcagctgaggaaaactgctagcaagaaccactgaccttcatttcataagtaattcaagaaatccttgcctttcatagacacactgcgatcctggctatctcttgcggtcctccaaagatatacagaaatagaaaatttttctatttttaatttttcagaattgggttataagtgatgggttctcaattttggagaatgaggcctacaaagggttatctttgtgtcttgtgtggtccttggtgtttgccaccctgtgttctaggccaggcttgctgatgtaggtccttgagcaagtcaccgaacgtttctgagcctcagttctctcccttgtaaatcgcagaggtagaaaggagttggacttgctgatttttgcagcccttctaggtctggccacctgggcttcagattactataagcctttggaatttgaatatgttgatgaagtgggctcagtgggtaaagaatgtttgaataaagggatacacggcatatgtcctctaggtactgggtgctttatacgggttttaatttatttcatcatccgagctgcgctggtagtgggtaaaattaaccccactctgcagatgtgcaaatcaaggctaaaggaggttgagtgacttgtccaagatgatccacttgctcagtggcagggctggtatttagagctgtgcaggcagatgtactgagggagggatccatggcaggataatggtggggctggagcaggaatcttttgtctgcctttgtttccttgcatgctgtttctgtactagaagtcatgtgctggttttgagataaactagctcagccaggtcactgtagcttatccactcactgtctgggaccacagaagattggaggaccctggttctgaaagggatcttacagttctttggatcaagctcctcaatttgttttgctttgttttgttttttttttttttttttttgaaacagtctcgctctgtcacccaggctggagtgcggtggcatgatctcagctcactgcaacctccacctcccaggctcagagattctcatgtctcagcctcccgagtagctgggactactgacgtgcaccaccacgcccggctaattttttgtatttttagtagagatggggtttcaatatgttggccaggctggtcttgaactcctgacctcaagtgatccacctgcctcagcctcccaaactgctggggttacaggtgtgagccactgtgcctggccaagcccctcaatttgtagctgagaaaatggaggtccacagaagttaggggatttgtttcatgtcacttgatgagttgacagatgggaagaaatggacacaaagactccctgtcttaggtgtttggagttgtatttttataacttttttttttaagaaaaaataaaacaacaacactcattcatttgagacacatggggtgagtgagttgcatttagttattctcacctccaggcccctttccagtgccaaaagattggagtaggcttatggaaaacctcctctgcttggctttgtggctggtgtctgagacacagagggcaacaggcaagctgagtatgagacctggtcactttccttgagcaggctcaggctgtgtttcctggggtcttctagctcacaggttagcagtccttcccaatggatgggctgagaccctgaccctttcctcctgcgtgcggctggcaccgaatctgtgccactgtaagagtagttgccacatgccgtgtggtttttgttctttgtcttcccgactaagaggcatgcttccagagcgtagctcccaaaatattgaatttaattaattggtggagctgcctaatggggaggcgggtatcaatagcttggacgagcacccagaataaaaaccatcccgtggttattaaaaagcacagtgcagatacttgacccttttcatgatcactatagcattaagaaagtctcacccaaataacaggcttcagaaattcaaattattatcataggaaagaggagttataattattctgcagggctggagggcaaagctagctgcagcagtggaatttggagaaaagccgatagcagatagaggaagaacgtgctggtagtggagttgtccagcagggggagcccaccttccaaggccctgtcatcattgaagccctggcaaggagtggaacttggcaatctgtaacttcctttctagagctaacatttcttgattatctatcaagcgggagtaaattagaggaagctaagggtacagcaacactgtgtcttactcattttttaggctctaaacccattgtatggtgtgaaaatcatgtgtagccaaaaataccctaaatatattttaatggtcagaaagttgcattatacatggtttttgtgtatgaaaccctgaatagtaattccctgtgctatccagtgtgcaaaactctggcctacagcaaaagaagtagaaaaagaaggtcaaaaaagaagttgtctgcatcttcatgctgctctgtttttaaggtaactgtcaaatctctagggcatggggtgaaggagagggaattcttaggagtatgtatttgcttgcaaggtttccgtcattcagtttggataaacagcctctaataccttcatacatgttgtttcagtccattttgcattgccattaaggaatacctgagactgggtaatttataaagaaaagaggtttatttggctcaaggttctgcaggctgtacaagcatggcaccagcatctgctcagcttctggtgaggcctcaggaagctttaactcatggcagaaggcgaaggggtaacaggcatatcacatggtgagagagagagcaacagagagaggagtacgtgccaggctcctattaacaaccaactcttgtgtgaactaatagggcaagaactcactcatcaccaaggggaggacaccaagccattcatgagggatccacccccatcaccaaaacacctcccagcaggccccaccttcaatactggggatcacatttcaaaaatatttttgagggtatttttagctacacatgattttcacaccatactatgggtttagaacctaaagaatgaataagatgcagtgttgccataccctcatgctatttggagaaggcaaacatccaaattatatcacgttaatagttttttttttaacaataatgaaaattaaatgagataatatatgtggaaacctccagcccaggaaatgttgctgtatggtaggtgttcagtaatatttgctggaaggtaatcagcatattgcttcagcagactggtccatgctggtctttgaaacattttagagaagaaactggccactagtgtccaggtgttggtcggtgttttctacttgaggttggcatgttctgcctgcctcctccggacagtattcattctcatgcccctgaatattgcttctaaagtccaaagtggaaaaagaatggagttgaaggcaacacagacctgagttcaaaatgccagacatcgctgtgtgacatcggtcatgttacctaacctctctgtgttggttccttttttttttttttttttttttgcacatgaaaatgggactaataggtctaaccttgaaggataagaggattaagagagaaccctcagagtgccaggaacctgtagagcaggtgttctgtaaatgctcatgtattcattctccttggaaaggtgttacagagaggtgtttttattattttttttttctttcttcaatcttacctcaaacttctttgttcacattagtggcacttctggatagctttctgcaagccctcaggaaaccccacatgacattactctaagaatgctgtccttatagcctggcacctcctgccagttttctaatcaagcaccagaaagctgcacttagaagggagatgttgaacttaacacattttttgaaagcaccaacagctgaattaaatgttcggggctaggactgctttactcaggggccacgtaggcaggtgatttgaggggtgatacaaagaaatttttgagtcaaagtatggctccacgttgaaagcattgggagtttcattattgagtgttcgtctcttgggtgtgctcattcattcattcaacaaatattatggagttttaatcctgtgataggcagattctaagtgctgggtgatgtattggtgactagtacagataaggttaccctcatgcatcttatattctcagaggaaaggtagaaaataaccacaaaacaaatatattatatgatgccacttagtaatgagtgccatgaagaaaaacgaaacagtatgagggaaatactattatagatactattatagaaaagtcagttaaagaagacctgtgtaaggagtaaatatttcagtagagccgtgatgtttgggagtgagttttggaaatacctgtagaaaagagtacctggcagagagaacagcagatggacctcaggacaggtaagaggtgggggaagggagagttggagaagatgtcttcagagaggttcccaaagccaggcctggtgggaactcatgggctgtggaaaggagtttggattttttttttttttttttttttttttaaacagagacttgctctgttgcccaggctggagtgcagtggtgtggtctcacctcactgcaacttccgcctcccagcttcaagctagtctcctgcctcagcttcccgagtagctgggattacagatgcctgccaccacacccagctaatttgtttgtatttttagtaaagacagggttttaccatgttggccaggctggtctcgagctcctgacctcgtgatccacctgcctcggcctcccaaagtgctgggattccacctcgcccagctaattttttgtattttgggtagagacgaggttttatcatgttggacaggctggtctcgaactcctgaccttgtgatccgcctgcctcggcctcccaaagtgctgggattacaggtgtgagccactgcacacagccaggttgtttctagtttttaaggattgtgactaaagctgctataaacatttgtatttaggtttttgtgtggatgtgagtttttgcttctctaaggtaaatacccaagagttggattgctaggatatgtgctaagtttacatttaactttataagaaacttccaaactaatttctagagtggccatgtcattttgcatttccatcaacaacgtatgaaagttccagttgctctgcattggaatcagtagttggcgtggttggtattttttattttagccgtctttatagtttagtgctatctcaatggtttaatttgcatttccctaatttgctaattatgttgaatatcttttcaagtgtatatttaccattcctatattctctttggcgaagtgtctgttcaggtctattacacgttttttgtttttttttttaattgctttttttattgttgagcttttagcattctttatataccagtactttcttggatatgtgacttgcaaatatttgacatgtttttagagaatcattctgaatgctgtgtattaagagagccatagtgggggaaaggtgggagctataggatcagtgagtgggtcattgtggtagttaatgggggagagatgatgatgggctagactaaggtccttggggtgaaagaagtgagaagtggttaaaaaagaatttcttttttgaaagtaggcccagcactttgggaggccgaggtgtgcggatcacaaggtcaggagatcgagaccatcctggctaacacggtgaaactctgtctctactaaaaatacaaacaaattagctgggtgtagtggcgggcgcctgtagtcccaggagaggctgaggcaggagaacggcatgaacccgggaggcagagcttgcagtgagctgagatcatgccactgcactccagcctgggcgacagagcgagactccatctcaaaaaaaaaaaaaaaaaaaaaaaaaagaaagtagagccacctggttgatgaatgagatgtggaatatgagggaaaagagacggtgagagtagtaacatacctggagatgttgagaatttaaatataaatcaggcaaggtttctatcctcaagtggctcccagtctggagagaggagatttactctaagcagttcacctggaacacagccaggtgtgctgtcacaggtcatgtgcaaagtatcaggggagcagaggtgagggccaaattactaagtgtcaggtttgcaaggctagctgtctggacagctgctttcaaactgtaatgtatttaagaatcatctggggctgggcgcggtggctcatgcctgtaatcccagcactttgggaggccaaggcgggcagatcacctgaggttgggagttcgagaacagcctgaccaacatggagaaaccctgtctctactaaaagtacaaaaattagccgggtgtggtggcacatgcctgtaattccagctacttgggaggcggaggcaggagagtcgcttgaacccgggaggcagaggttgtggtgagccgagatcatgccattgcactccagcctgggcaacaagagcgaaactccatctcaaaaaaaaaaaaaaagaagaatcatctgggaaggttgttaaaaatgcaggtggctaggccctgatccctcaagtaggagacctgtagttagcaagcaccagaaataattctgtgtaggtgattggttgaaaccactatgagaaaccctagggggagctggggagagttcacagaaaaggtgatgtttgaaatgggatttcagcatttagtaggaattccgacttggagaaagttggagaaatgacaaccaggcagaggcacaagcagaagcgaaggtctggaataaggttagagaatggctagaggctagaataagcttatgttgggtgaggtgatgaggattgatcaaagagcacgtgtctgtttagggatgggatgggagtcacttgacctcctgtgctcaatgagtctgtgagtctaaagtgattgaagcaattcatcagctcctcagttattaacagggggcctgccatggtgaaatacaccaggcagtccaagagccacgtggacagaatgtctgttgtgctgtcaaagtctcacgtgactaggcatgtttgaggaaagctactgctacagtgaaccagctggctggaggtggtgtgttggcagaagattggtggaagaacgcactgtacctagtaccgctttgggcctgcgttgaagctcacagactccacatcttctttttgtacatcatcctgcccacttttcgagcatgctgcagccacatcttcctgtggcctaactgctaggttgttgcatcctcactgtgtgcaaagcatagttcaatgcacttttttttttttttgagacagagtctcactctgtcatcaggatggtgtgcagtggcacaatctcggctcactgcaacctctgccccccaggttgaagcgattctcctgcctcagccacccgagtagctgggactacaggtgcataccaccacgcccagctaatttttctatttttagtagaaacggtgtttcaccatgttggccaggatggtctcgatctcttgacctcatgatctgcctgcctcggcctcccaaagtgctgggattacaggcgtgagccactgcgcctgacccagttcaatgcactttatgtggcttaattcacttaattctcaccacaagcttatggacgagttagaattattatctctgttttacgatgagcaaacaaagacacagaaggatgaatgactggcccaatgtaacagagctaagaaacagaattgctgggatattaacccaggtagttttgacttcatggcttgtgcttttatttattatattattattattttttgagatggagtttcactcttgttgcccaagctggagtgcaatggcgtgatctcagctcactccaacctccatctcccgggttcaagccattctcctgcctcagcctcctcagtagctgggattacaggtgcccgtgaccgcacccagctaatttttgtatttttagtagagacggggtttcgccatgttggccaggctggtcttgaactactgacctcaggtgatccgcccacctcggcctcccaaactgctgggattataggcgtgagccactgtgcccagctcttgcttgtgcttttaaacagtatgccgcactaaccttgtaggggcatctttagagtatgagaaggaggagaagcagtagcagcagcaacaacatacataaggtacttactatagaccagtcactagcttatgtggtattcttagagttagtcccagtaaggactatttcaataatacacttttatgttctaaagatttttctttttgatgttagtccttgggttgaaactttctatttttcttccttcttgtctggttaataacaaaagggtatatggcctgtgagacttgaaagagcagtaggaagtgtgagaatatcatgggagcagggaggcagaagctccggaacatccccagggcttccacctgcagctcagggatcctttggccagggcttcatggagcactactttagctaatcatggcacagtttaggggtgggagagctgctcagttctaacctgactcctactcaagattcctaacctgactcttctgttacataggatgactggctgccttggattgggtggcggggggctccaggatcgtcggatttctccttccactcctggctgcctctttaataaagtagggtgcagcagcatgctggggacaggagcaggtgggacccagtgtcaactgccctttagagtggttgttctatgtgagactgtttgctgttacgagaaagggccctggattactatgtttttagagctcttcaaaatctttctctccactttctcttcaagcagccagtgtactttcttccagcaagattctttctgatttaccacgtccgtttggctaaagtctgggaaaacaaatgatgaaatatacgtgtattgtttactaaggaagaatcatgtgactaaagggctttgcttctttttgtaaggtttagagagaggtgctgtagacaggtgggtctgggggcctttcctgcccctgacccccacacttttatttccaagttctcaactgtgttggctcttagtcagtttgggctgttataataaactaccacagactgggtagcttaaacaagagacagttcgggaggctgggaagtctgagatcagggtaccagactggtcaggttctgcttgagggccctttttcctggtttgcagatgagagaggaaacgacctctgtgtcttttcttgtaaatgcattaaccccatcatgagggctctatccttgtgacctaatcagcttccaaaggcctcatctctaaataccatcacgttagggattgcggttttaacatatgaatttgggggacacacacattcagtccttagcagctgagtggtttagtttgctgcacagcagtcctccaggtaatgcaggagtacagcatgatctgggagagaggtttgagctttcctttggcagggggagagagggagtacctgggaggcttcctgagcaagctaatatctgagctgggttttgaaagatgcttggagctcattaatccaatggggtggggagggattttggagtgaatgaaaaaggatggcattccaggaagcagacacagcatgtgcagaggcatgacatgcatggcaggtaagaggataagtgtcagtgagctactgtgcaaggatgccctagtgggagatgaagctggcacaggttagaaagagttcctagtgcaggccgggcatggtggctcatgcctgtaattccagcactttgggaggccgagacgggcggatcacaaggtgaggagatcgagactcatcctggctaacacggtgaaaccccatctctactaaaaatccaaaaaaatattagctgggtgtggtggcgggcacccagctgtagtcccagctgctcgggaggctgaagcagcagaatggcgtgaacctgggaggtggagcttgcagtgagccgagatcgcgccactgcactccagcctggcgacagagcaagactccgtctcaaaaaaaaaaaaaaagaaagagttcctagtgctacatgggagctttggacattgtattagttcactgtcatgctgctaataaaggagtacccaggctgggcccagtgactcacgcctgtaatcccagccctttgggaggccgaggcaggcagaccatgaggtcaggagatcgagaccatcctggccaacatggtgaaaacccatctctactaaaaatacaaaagaaaattagctggggatggtggcgcatgcctgtaatcccagctactcgggaggctgaggcaggagaatcgcttgaaccagggagttggaggttgcagtgagccgagatcatgccactgcactccagcctggcaacagagcaagactctgtctcaaaaaaaaaagacatacccaagactgggcaatttataaaggaaagaggtttaattgactcacagttcagcatggctggggaggccgcaggaaatttacaatcatggtggaagggcaagcaaacaccttcttcgcaaggcagcatgaaggagaagtgcaagcaggggaaatgacagacgcttataaaaccatgagatgttgtcagactcactcattatcacgagaacagtatgggaaaaaccacccccatgattcaattacgtccacctggtctctcccttgacacatggggattatgggggatatgggagttacaattcaagatgagatttgggtggggacacaaagcctaaccatatcagacatatatcgaggagcaactgtagtgtttcagtagggaatgatgtggttaaacttacgtttgaaaaaaatgtgacagtcagtgatatggaagtggatttgaaggagaactaattggatgcatggagagcagtggatgcatagttttgctgtggtccatgaaaggcatgatgcatgtttgagctagggattgagagagattaagggagggtcaaagcatccctttcattcgtccacactctcagaataaactcattttctctgttatggggctgaatggaggtgaatttggtaggatccctgtccttaaaaagtgtataatcaggctgaggcgggagatcacggggtcaggagattgagaccatcctggctaacatggatctctattaaaatacaaaaatctctattaaaaatacaaaaaatatatattaaaaatacaaaaaaaattagctgggtgtggtggcgggcagtgagccgagatcgcgccactgcactccagcctgggcgacagagcgggagactccatctcaaaaaaaaaaagaaaaaaaaagtgtataatctagagacatctaagaaaccagtgataatacaagagatggagccactcaggttttttgtttcacaaatatcttttgaccatctactatgagctaacactttctggtaggtgctggatgtatgacagtgaaaaaaataagcaaaaatccctgtctttgtttaggtcacatacaagttgaaagggcacagaagtaatacactacaaaagtaaatatataatatgttagataatgggtatgacagagaaaatacagggaaagagagaggggtgttgagaggagggctaccatctttaaaaaggtgacatttgaggccaggcgcggtggctcacgcccgtaatcccagcattttgggaggtcaaggtgggcggatcacatgaggtcacatgaggtcaggagttcgagaccagcctggccaacatgatgaaactccgtttctactaaaaatacaaaaaattagccggatgtggtggcaggcacctgtaatcacagctactcaggaggctgaggcaggagaatcgcttgaatgcaggagaatcgcttgaacccaggaggcggaggttgcagtgagccaagatcatgccactgcactccagcctgggtaacagagtgagactctgtctcaaaaaaaaaaaaaaaaagtcacatttgaataaagagcttaaggaagtaagagaatgttataaatataaaaatatacaggctaaaacacctcctggaggcatcatggcatagtagctttgagcatggactttagggttaagtagacctaaatttgaatgctggctccacaccgtactgcccgggtgaccttagacatgctttctcaccctgttaagtgttgatgtcattatctatacgataggattggtgacacccatctcccaggattgccaggagcctggtgcacagagtccttgctgaatagctcatcttcagaatgttgaggatgagtcagatggaggcatctcaaaggctttatggagaaggggccctgggagatgagccctggaggacttgaagcaggaattcctgcccagaactctccgctctgctgttgcaggttttgcagaacagagtgccagggacttggagcagagatgcagaagccccagaacagccccggggcttccgcctgcagctcagggatcctttggccagggttttgtagtgcactacctcagctaatcatggcacagtttaggggtgcgagagctgctcagttctaatctgactcttaagatttccaacttgactcttctgtaaaataggatgactggctgccttgggtttggtggcaggggctccaggaacgttggatttctccttccactcctgtctgcctctttaataaagtagggtgcagcagcacactggggatggggcagtcttgggtcctgatgtcatgcccagttctgtggccctagaggctttcttgaaggcccccagagcttgcttttctgccattctgagaaggattgtgtccctaagcaggtctggaccctgggggaaaggatgtgagaattgctcaatcggagctcacagtggaggttaagagagcgtgggtgggctggaaggcaagtcggcttttcttcagcagctcaaccagacagtgcagcaggaatgactgttttctgcagagctggaggaggcagcgccgcagcagtaatccccatcctggctgtgaaaaatcccttccttgcctgcaagtgacagcagctagggatcttttggtggaatctgatgccaggatgtgaaggctctgcttccctctgcctatggcgtgccatcaaccttagggatcctggtgcctggcctaagggggcattactgctgtttggcaaaatcccagccacttcccagggctcaggaagcagcttttggtggggagcctgggaggcagcagcccctgatgagaaagagagccagcagggcaccggattgcctgggtattcttttaatctagttcttttttctggtttcattttctcgatcttttgtttttattcctttttttttttaacttcatgcattcttattttattcattcactgcatttttcttctttactttcttccatcctaatttttacctttctttttctctttcttctccttttctttcctgcctttcatctacttatttgttaattcagtattaatccatctagcattttctcagcctcttgctagagctggaggtgcaggtaacaccttcctttccctctggaggagctcagacactgtgggaatgtggggagaagacacaggcaagcaggcaggagtggtagttaaaagcctgttagttctagactctgcagtcccaccagtggcttcttcactgggttaccttaggcaaattaccgaacctttctgagtctcggatgcttcagcgtaaaatcaggataacagaagcttcttcattggattgctggaaacactagagagagtgcagggaaactgcctagccaagtgcctggcatgtacaagaatgcaacagactatgattaatatagtttgacaaacactattagaaatcaggataaaggaaagcagagaaataaaatacttttctgggtctggttcttgctcttgaaagtgagaatcaagataggcacctgagttcttcaggactgagcccctcaatttcaaatgaggaaagaagcccagtggtaggttgtatggggagaaaggagctcagactttggagccagaacatctgggcccaaaaaatctgggcagcaagcgggcaagtgacgccacctttctgagccttagttttctccatatgtgaagcagagataataacaaaggattgccatacatgggaggaaaaaacccactttttctgctatttgtcttaggtgcattggctgcggccctgtaaataaactaatgaaagattaacaagagaaaaacaaacagaagtttatgaggtgcatatacttaatttattaagtgcagctgtgcatacacttggaagcgctgggagttcagtaactcaaaggggtgattggaacttgggcttggccgggcatgatggctcacgcctataatcccagcactttgggaggccgaggtgggcggatcacctgaggtcaggagttcaagaccagcctgaccgacatggagaaaccccgtctctactaaaaatacaaaattagcctggtgtggtggtgcatacttgtaatcccagctactcaggaggctgaggcaggagaatcaattgaacctgggaggcggaggttgtggtgggccgagatcgcggcattgccctccagcctgggcaacaagagcgcaactctgtctcaaaaaaaaaaaaaaaaaaaaaaaaaaaaaagaacttgggctttacagcatttaaaaaaatttttttagacaagggacaagacaaagaaaaggattttgaatttccagggcagcaaattgtggaaagtaaatatatggggaagctgatagaagccagtaaagttcgttatatagatgcctctggtgccttgggctgatgagggtttaaagttatcagtgattaatttctgtcctttctgctggaggtttaggggatcagctttgcaaatttctgtcctgcttttaggcaaacacagggagggcagagagcttttcttatatctgcttcttctcaactgccttcagctcaaaataatccttatgccaaagtggtatattttgggatagcgtattctggtcccctatgacaactgaaatgagtgactgaagcataagtctcaatcatcgaggtttatgaaggcagcttcagggcacgtctgggaaaaacataagccacagacacatctgaggctgcttttccgaggaggttttcaggaaatttagtctttatacattttcttaaagaggaggaaggcatgtaggaagaggggcaggtaggcggtaaggcaaatgcttatactcttgtgagactttccttagtgcccggtaaatctccattttacataagataaggtgaatgatgaagagaaaaaaggagtaaaggaagagtcagttatggatgtctctgggtggttggagaatgagtcttgactttgtcctggacctgggaagataagcttatagtcaacgttattagcttattataatgtagaatcagagctagacttaggctggtgctgtggctcatgcctgtaatcccaacactttggtagacagaaggcaggaggatcacttgaggccaggagtttgagaccagcttaggcaacatatcaagacccctgtctccacaataaaaaatgaaaaattatctgggccttgtggtacgtgcctatagttctagctactcaggatgctgatgtgggaggatcacttgactccaggagtatgagtctgcagtcagctgtgatcgtgctactgcactccagcctgggtgacagggcaagaccgtgtctcaaataaaaataaagaccttgatttagatcgtagacctaaagttacatttggcacgtccttgtttatgggagggcagccaaggtcacttttgaatgatctttgggggcagtcctttgcagatgcctgaggccttccacctttccacggggacctggctgatgcataatgtaacagctattcatttggaagagggtgttgcaatgactcagcttctgggcttaactgtcccttttgcataagaagtttggtggcggggggggggggggtcccgagatttttaatttttctttccacctacaactgttaggattaattggtttaatatatgaacaaagtttaaaatagtacctagcacttaggaaatgttaaatgaatagctgctattattattattattactatcatcgtcatcattatcattgttactgtcgcatagaaagccagtgctggtgaccgcccagcttcctttagtgacaatatgcccaccccactcctttccttcagcagtaaagctgcctgttgctagcctacaaatggggaacgtgtccccatacttgccactgagcctgctgtttatggaattttctgagccagtgaccagattgggctcccaaggtgaagggcactgcagtggctgccacagagtcctgcccagaaggcatcaggtatcaaagagaaccctattgatcttggcaccaggagaggagacacaagggccgggcagcagaccaggatatcatagtggttgaagggctgcatctcgagatagactagacagatccaaaggcaagatttgcctcttccctggtgcatgatgttctgcaagttgctgaagccccctgagcttcggtttcctcatgcgtaaaatggggttaaaaatagtttttgctttacggggttgtgtgaggaatgatgatatggtgcttgtaattcgctcagtgcttgagtaaacagccacatgatggttgttcttattatttagttatttaggagaaaaatgctccccgtctggagagagggtgaagtgagtcactagaaagtagtacatactggccgagcgtggtggctcacccctgtaatcccagcactttgggaggccgaggtgggcagatcacaaggtcaggagtttaagaccaacctggccaacatcgtgaaaccccgtctctactaaaatataaaaattagctgggggtgtggcgatgggcacctgtaatcccacctactcgggaggctgaggtaggagaattgcttgaacccaggaggcggaggttgcagtgagtcaagatcgtgccactgcactccagcctagacaacagagcaagactctgtcttgaaagaaagaaagaaagcaagtagtacatacagatatcctgagaacttgtcttttaattgtgtgtgtgtgtttttttttaacacagagtcttgctctgtcacctaggttggagagcagtggcacaatctcgactcactgcaacctccgcctcctgggttcaagtgattctcttgcctcagcctcccgagtagctgggattacaggtgtgcaccatcacaccgggctaatttttgtacttctagtagagatgggggtttcattgtgttggccaggctgatgttgaactcccaacctcaggtgatccacccgcctcagcctcccaaagtgctgggattataggcgtgaaccaccgtgcctggctaattgtgatggtttttaattgtgatcattgtaccttggagacctgtgttgtggctttggccttgcgtctgcttggctgagtgaccctggacaagtctgttccctcgtctgcacctagtctccccgttggctaatcagagttgcagaggctggagtaggagtgccacagtgcgcagtgctattattccacaggaatctctctcccagaaactgtttctaccagcccagagcccatgacctcctggacacccagagtcccccaagacattggccccttgtgagttctgtgtgcaggccctgggtgaggcagtgagactagggggctgagtgagaagggtcccaggccattccatgggggagtctgacaggaaataaagccctctggctaaacagaaaataccgtgggataatggaagaagtgcgtagttaagggtgagaggtgctgggggttacaacagaactctgatgaggtgacattggggtgggaccaaaatgacaaggagggagcaaggaaagaacattccaggcaggggaacagccggtgcaaaggcctgtgagcaagaaaaccaagctctacaacatattttaaagaagtttattctgggctgggcctggtggctcatgcctgtaatcccagcactttgggaggctgaggtgggtggatcacctgaagtcaggagttcgagatcagcctggccaacatggtgaaagccggccaacatggtgaaaccccgtctctactaaaaatacaaaaaattagctgggcgtggtggtgggtgcctgtagtcccagctacttgggaggccgaggttgcagtgagctgaggtcacaccattgctctccggcctcagcaacaagagcgaaactccatctcaaaaaaaaaaaaagtttattctgagcacacatgggtgacctaggcctagagagcagtcgagaggccctgagaacgtgtgcctgaggccatcaggttacagtttggtttcatacatttcatggaaacaggaaatataagtaaaatcataaatcaacacatggaaggtatacattggttcggcacaaaaaagcagtacatcttgaagctggggcgggtggtgttggggtgcttacaaatcatagatgggttttagagattctttagttggcagttggttgaaagagtccagctttgtctaaaggcttaaaggaatgcttcagtaaagacaccagagtcaggttggaaagtaagctaccttatatgggatgaattaaaaaaaaaaatttaacaggattttatggtttgtagggcatgacttaatgtttgccttgtgtggcctcaggtcttgtttataatttggtaccttattgtcacaaagactaaaattttgttagtctaatgatctttttaactttttttttttttgagatggagtcttgctctgtcacccaggctggagtgcagtggcacgatctcagcttattgcaaccttcgtctctcaggttcaagcaattctcctgcctcagcctcccaagtagctattacaggtgcccaccaccaggcccagctaatttttgtatttttagtagagacagagtttcgccatgttggccaggctggtctcgaacacctgacctcatgtgatccacctgcttcagcctccctaagtgctgggattacaggtgtgagccaccatgcccagcatttttttttttttttaaagacagagccttgctctgtcacccaggttagagtacagtggcacagactcaggtcactgcaaccactgcctctcaagttcaagcagttctcgtgccttagccttctgagtagctgggactacaggcgcccgccaccacgccctgctaatttttgtatttttagtagagatggggtttcaccatgttggccaggctggtctcgaactcctgacctcaggtgatccatctgcctcgagcctcttaaagtgccgggatgacaggcgtgatcctccatgcctggccaatgatctctttttcaacattaatgttggtccattgtgcctaaactccaaaagggagggcgtggaatgggacatgtctggcctcccttcccatcacagccaggaattcagtttttcaggtttctctggggtcctcttggccaagaaaggatgcagccagttgcttgggggcttaggattttaattttggtttacagacctgagaagggcatgggggacaggggtgctgggggaatggggttggcttatttgagaagagaaaggacagctcggatgtggaaaatgagaaggggaagagggccctcaggctgtgaaggaagcttgaattacccaaaggacagggggacacagaaggattagaagggggcagctgcctgtgaagagtaaacagggagaacccgtggggaggcaggaaaccaaaggagagctgcctttgtccagtggggagatgtcggtggcttggctcccagtgataaccagggagttgaaaggagatggattccggggctgttttaaagataagggttggtggtggtcggggtctgggaggtgagaggaagggaggaatcctagaagactcctacatttttagtttgaacacctagtggggtcatttcctgagataaggagggtgggagaggagcagtttgcagtggaggtggcaggaccccaggagttctgtcttggatgtgatgagtttcagacacctattcactttgctttctctgctttccagagggaactcacccaattactcagtagggcagcactcagccaccagaagcactgcccagctggccatctgccctgccttaggcagggggccgtgggcaactgaaggtggtaagactgagtgctgccacatccacagctggtgctcagcagggcctgttctctgtgcctggctctctatgtctctatctgtttctctatgtctctgtttgtctctatctctctgtgtctgtctatgtatatctgtctttctgtctctgtatctctatatatctttgtctgtctctatcactctctgtctctatctctctgtgtctatttgtctctatgtatctctgtctctctatctccgtcactatctctctgtctctctgtatctgtttctctctctctgggggtctgtttctgtctatctgtctctacctctctctctgtttctctgtctctgtctctatctcagtctctgtgtatctgtttctctgtgggtctctttgtgttgatctctctgtctctctctgtatctctctctctctctgtctctatcagtctctatataagtttctctgtctctctgtgtttatttttatctatctctctctgtctctctctctctctgtctctatctctcagtctctatatattttttccgtttctctgtgggtctctttgtatctctctgccttatctctctgtgtctctgtcacagtctctctatatctgtctctctgtgtctgtctcagcctctctctcttctctgtctctatgtatctggctctccctcccctgtcaatagcttcctccaggtgtttcagatgactggtgttttcccctcatttcggtgccttcctttgtacttcatgcatatcacagccctaagcaaggcatccagaaggtcccctttgtctctaggaaggagggcacttatttggcaccgtgtgttttcttctccagcagaaaggagcggcttgtggagtcaggtctggttcccagatcttggcagcgcaggcatctctcattgacggggtgcctggccctgcctgctgctgcctccaactgcctccaactcagagtccaaagccagacttggtacctttcccccaaacccacagtgatgggtttgcacagggaacttcaggaacacagaccacctcacgtcagggaagccttcctagaggaggtgatgagctgagtgaggatgagtcaaaaacagccaactgaagaaagtaggaaaacgtagggaagggcatgccaagagagggaacagagacgtgaacctgctgtgtgagggtcagggcgtggggaatggagctataagtgcctctgtataaccgagctaagtttgaagcccaagaagacagattccaggcccctggggacccaaggctcgatgatgtaatggaaaatccgtagggcctggactcagtcagagctgggttgtaatcctaataccatggagggaaagtgctgcttagtggttaggactgtgaccaccagagccagagagcctgggtttgaatgacagctctgacacttactagttgtgtcattttgggcttcaatgtccacatctgtaagggagagtaataccagcacacctacctcctaaggctggagggaggatggcatgagttcagggtcagagcagtgcctgacagagctgtaattattgtatacaagttgagtgaccataagtaagttatttatcatttttagggttgggcatggtggctcacacctgtaatcccagcgctttgggaggttgaggtgggaggatttcttgaggccaggagttccagaccagcctgggcaacatagcaaggccttgtctctacaaaaataaaaataaacattaaaaaagttggaggtggtggcctgtacttgtagtcttgactacttggtaggctaaggcaggaggattgcttaagccaaggagtttgaggttagagtgagctaagattgtaccactgcactccagccggggcaacaaagtgagaccccgtctcttaaaaaaaaaaaaaaaaagtcatctttggacctcagtgtcctcatcagtaaaatgaggtgatagcacttcctgacttcctggccagggttgtcgtgagagttggggatcatctagggactgtctgagcagtgcctgattcttttttttttttgagacagagtctcgctctgtcacccaggctgtagtgctgtggcgggatcttggctcactgcaagctctgcctcccgggtttacaccattctcctgcctcagcctcccgagtagctgggactacaggcgcccgccaccacgcccggctagttttttgtatttttagtagagacggggtttcactgtcttagccaggatggtctcgatctcctgacctcgtgatccacccgccttggcctcccaaagtgctgggattacaggcgtgagccaccgtgctggccacagtgcctgattcttaaaagaggctcagttaatggtagcaaccccaccaccaccaccaccaccaccatcaccaccaccaccaccaccaccaccaccaccaccaccaccaccaccatcatggttcttattatacttcctagtgggctgtgccagcccctccttgctgcttaatcccttcctctgcccagcaagcgtcatggatcatccagcctggagactggaaattacaggctataaatctgggccgtggttgccctggaaagatgatctgccttttgcagggcagcagcaattcaaatgctttgctggctgtgcgggcagctgcatcctcagccttcccctaagtcacatgaaaggccagcagcacggccttctctgaagctggtgcgcattagcattccccacagatggcttcggggctaggcgctgaggaggaaggagctgtgataaatccagggaaatcctgaggctgtcccactctctgctccctccacttatgtggaattggatttccacttgtgctcctcactgatgatgagactggagccagtgtgctggaggggaaagggcaggctgtggaaaccacgggctgggattcctctctgctctgtccttgtctgcttctgatctggtatgtgtcccgggaaggcaacattctgtaattaaaactggacccaggacctagactgcctgggtttgaatcccagctccaccactgaactagacacacagccttggggaaggcacttcatctccctgtgcctcagccttcacgtctgttagatgcaaagagtgttgataagcgtttgtatttgtacaactcataaggttgttatgaggatgaaatgaaccaacgttcaataaaactcacctctctttgctcagctctttgtctcttcactgatgaaatgaagttgttgaactggatcctctgaagattctagttgagaattttcggcacaacaatgtgtgaagtgagctctgcttttgccactgacctactatttgatcttggatgaggaacttaacccctgtgaagttttctttctctctctctctttctttctttctctttctttcttttctttctttttctttcttttctttctctctctctctctgtctgtctgtctgtctttccttctttctctctttctttcttttttcagagtctcactctgtcgcccaggctggagtgcagtggtgtaatctcggctcactgcaaactctacctcctgggttcaagtgattctcatgcctcagcctctggagtagctgcaattacagacgtgagccaccatgcccggctaatttttgtatttttagcagagatggggtttcaccatgttggccaggctggtctcaaactcttgacctcaggcgatctgcctgcttctgactcccaaagtgctgggattacaggcgtgagtcaccgtgcccggcctgaagttttcattttgtttgtttaaaggaaatgataatacctacatgacagattctagttaatacctgaattagaatatatacgtcatatatatatatgtagatagatatatatcagagtgttttgcactttataggtcctcagtaaatgacagcaatgaatttgacattggaaacactatagagggaagttctatattgagtaagaaatcacatcaactctcaagtctgtttcagattcaaatttagttcctgaaaaagcagctctgatttaatggagaaatggaagatacagaaccaagaaggaggaaaataaagaagggaggcaggagggaagaaggaaagaaaataaagaagggaagaaagacggagttcccaagaacgagcctctggtgaagtgcccttttctaatgggataaaaacagaaaagatggagtttgtgcagtatacagtcgccacgttttctcaacaacatcaggataccaatgctttctgggttttctttgtcagggattgagggagcattttcagctctgattctggaaatggctagggtgtgggttcccaaccaggtcgatgggcatggcagccatagctctgggaactaggagttggggagttggtcctcccaggggcaacaggaccagtcaaggagtgagattcaaggcagagcctagacactgggactcaccggattactgggaactggcttcatagagagcccaactggtcaaaggaaaatgaggaacccaggctaaggtcagcccttggttcagtcagatactgtatttttcaggtaatagggtgtagtattttgacctgaagataatgcaacagcccagggtaccattggacatcaagctctgagtctgactggcaaaaaaggtgatctggagcactccaggagccttagtcctggtggctggttttggaaaagtgagttgatcatcaaccctttcagacagggccacagagagtatcaatcagaattttcccagaaaatggagaaaacctccatttattctgttattaactaagggcctacaaggggctatgggttcaaagctgaaatacagatacaccgtcagcaagcctgagatctgaaccaatgttcactatcaagagttactgtaataaacaacacagacccccaatggcatgaatgaaagggatttgttttgctcatgtgccttcaggttggctaggagttcactcttcttggctgggctctaagatgcagccatctagttggctctaaggtgcagcttgagtccaggtctcctctcacttgctccttggattcgtgggacagccaggacatgcttttctcatggcagtgacagaggtgcaagagggcaagtagaaacatgggacgtctctttggctcatggttcaaaactggtcactatcaaggctcccctgattaatcaaaactggtcacatgatggggcctggtgcagtcacatgactacccaaagtcagtgggcaggagagtcactcagcttctactgggagaactgaaaactcacttggcaaactgtagaccttgggggctgatgaagaattgtggctaataattcaaactgtaaattgccctccccaacataagcatatttatttataaatcatgaatactgagaaagttgcagataccaggatgaaatcttttttttttttttttccagacggagtgttgctctgtcacccaggttgtcacccagtggtgcgatctcagctcactgcagcctcggcatcccaggttcaagcgattctcctgcctcagcctcctgagtagctgggattacaggcacctgccaccatgcccagctaatttttgtatttttagtagagaccagctttctttttttttttttttttttttgagacggagtcttgcactgtcaccctggagtgcagtggcgcaacctccacctcctgggttcaagcgattcttctgcctcagcctcccaagtagctgggactacaggcatgcaccaccatgcctggctaatttttgtatttttagtagagacggggttttaccatattggccaggctggtctcgaactcctgacctcatgaccacccgtctcggcctcccaaagtgctgggattacaggcgtgagccaccatgcctggcagtagagaccaggtttcaccatgctagccaggctggtcttgaactcctgacctagtgatccacccacctcagcctcccaaagtgttgggattacaggcatgagccactgtgcccaccaaaataatttttgtcagactcagacaaaatggggccagaaaggagaggagactcatacttacctgtctgagatgagaactgttttcaaggactttctaaaatcactttcacgtccttcacgcatctcctgctttgataaatcactcgacattctttaggactgcagtaattcagataagatgttctcggaagaacacttgcccagtaacggcatctcccccaacgaactaacaacagcctctggaaccaatgaactgtctttctaagcagcttatgtaaatctctcattgctataaaagctcccctttatccttccctcattgagtgcactggtggcttgtcatttcatgcattccggattataatctttattgtattccaggacaaacccaacatagctagagagacttttctctagtgtcttttaagattgacaatactttactaatatattgtgtccataaaatgtacatgccaaaaagaaatttaagggtgagatcaaagattggaatgaaagtgctaaccatttttccctgtactccaatgtaccatcttggaaatccctaggggacaagtgtcccattttggagatcaagaccagctgcagtgaatcatttgggtcatttagagagcttgatcacatgcagattccaggctactacttttccagcttgtggaatcagagcctctggagaggaagcctgggaatttgtattggtgagaaagttccccagatgatatgggcgcatattagagtttgatgcttacattaaaaaagccataggtctgtgatggaaagaagctcaagagtggcctctaagaacactggaattgcactccaccatacccagtctggagggtgctggtgggtggtcaggaaagccattctgaatgattgatacagagttgagttctgagaaacaacaagacctagtcatgccacaaaagagaaggaggctgtgcccggcagacattgctgcccgtggaaagagctgtcattgagagagtgccttccttgctcagggaacgtatggtatcctgagtgtccacactcaggagaggatctagcccagagaggccagcgttctagatgatcaccaaggtggacacctctccagcttcagtttggaaccaaaaagtccagaaataatattgtgagatagactagaatacatatatgattgattttagagtaggtgagtattgctaaaaatcattgaaatttattttgaagggttcatctggagcaacaatcacagaggggcccaggtgacacttgagctccagacctcaccttatcaagggcttccatttggattctgtttgtttgagacagcgtcgcactgtgacccagagtgtttagaatcatgcagattgtgcagagacacaatcatgactcactgcagcctcaacctcccaggctcaagcaatcctcccacctcagcctcctgagttgctgcgaccacaggcatgtgtcaccacccatggcaaagtttttgatttttttgtggagactgtgtattagtccattctcatgctgccaataaagatatacttgaaactgtgtaatttataaaggaaaggggtttaatgaacttccagttccacatggctggggaggcctcacaatcgtggtggaaggtcaaggaagagcaaaggcatgtctttcatagcagcaggcaagaaagtgtgtgcaagggaactccccttttataaaaccatcatgtctcatgagacttattcactaccacaagaacagcatgggaaagacctgcccccatgattcagttacctcccactgggtccctcccatgacacatggggattttcacagttcaagtaagatttgggtcgggacacggagccaaaccgtatcaggcagggtctccctgcgtttcccaagctggtctcaaactcctggactcaagcaatcctcctgccttggcctctcaaaatggtgggattacaggcatgaaccaccatgcctggccacttagatttttgacatgaccttcagatgagggtcctgataagctagaggcaatccagcatgattattagataattcaaagcttgggccccagtcctggctagtgctgcctgtagggctctataaattctgttcgtaaataaatcctgtgaatattttttggaaaattcagttattgttaccttataatcttaggaagttaaatgctttaatttgctaaaggtaagtgttcatttacatgaaaattttttgggaccttgttttggcatttctgtatttgaatatatttcagtttgtgggagtggttgcaaataaatggaagaatctcgtctcctctcttgacttcgaggagaccctctcccacaaaatttcctgacaccctggggtgttctccaaccagaggagggagttgtttgtgctcactcacctacaaatcctgtttccaaagcccaaattcttcttgtctggggacccacggtgtcccactcacgagaacaatgatgctacccacaggagatcaaggcctgtgtgggtggatttgaactcatcaaagacagtgcatgttttcctgttgatgtggctggaaaagagctttggggtcaaaagggccagcaggtctgtgtgtgagaaaggagcaggatggagctgcttcctcagcaggtgcatgttggacctgctcttcaggaagttaagcatcttttagctttgcagctggagtgacacagtctacggagttctcagcctgtccctagacttcactgcctatgctcattaatacattgctaaagcccaggttatgttgtctccatgaattttaaaattttctgcttgtgcagaggggattttagcatttcaggattaattacctaaatactgattcctaatagggaaggaaaaaaattgttttagccctcatcgagtggagaatttataagccgtgttgtgtttacatgggggacagggagaatcagtcagtcctttgcattattccaattttcgttcaacttaggtttatgtgtcaggcactgtgacagctgctttcttttgtataatcacagatttaatcttcccaaacaacaagtgaagatagtttaacttcatccttgttgttttaaacaggtttacttaacaaatatatattgaacctctactatgtgctaggcactgtttctaggtgcttagagtacatcagtggacaagtcagacgatggtctctctccctggggagcttacattctatgaaagggaacagaaaatgaagaataagcaaaaaaaaaaaaaaaataagttacagtatatagtttatagaagatggtgcatgctatggaaaaaaagaacaagtaggatccaaagtaccagacagtggcagtcagaggggaggcttcactgagaatgtgacatttcagcaggacctgagggagaggtgggtgggccacgcatgtgtctgtagacagagagttccagatgaaggaacagacagtgcaaaggcaactaatgcacaggaagttcaatcactggaattcatcttctttctttgttatctaagaaatgtgccaggccttgaatatttcttatctaatgtaccattgtaggagagccaggtgttaggctgtgaaacactacgtcatcaagattaaaaagcaattgtatggggggtgatggaactcttccatatcttggtagtggtggttccctgaatgtgctaaaactcatagaactatacacccccaaagtctattttattctatgttaacttaaaaaataaacatttggaaaagcactttagtgcacttgattttggtctgctcaaagacctgtgaagtaggaagggcagggtattggtatccccactttgcagatgaagaacccgtgacttagatgtcactgagctgcaagaggcagaggtggggctcaaagtcagatccatgccaaagctcattctcatgtaaatactgcacctgccgtgttgccttccaaactaaccacactgtcagactttctggcaatgggaaacacattgtctaaaaaaaaatcggaataataatagcagctgacacagattgtttaccatgtgccaagcactgttttagatacttggcatatgttaagttgcaggaactctatgaggtaggtactattatacccattttgcagataagaaaactgaggcacagagaggctaagtaattttctcgaggctttgtaggtggtagatagcaaaattgggattggaacccaagcaacctggtcccaggatccatgaacttaaccttcaagcttactgcctctgtctacctgtgtccagcaccagagtgctgaggccattgtagtccttagcctgggtttgggagggggcttgcacttgaagagtcccttttatataggatttgttttcaaagtggtataggttggccttttgtatgacccaatcttgcaaaagaaatttctccccttttgcttgtcatggtgcccaaagtatcatcaatagagtcacctcagtgaatcttaaagactgagcaaaaagattgctttcaggccttataccttataccattggaagaatcattttaatagcgtgattgtattgaggtgctggtactctgggctgggcatctggcctgtcctcctcttcagacaccctctcttattcttaaataccccatctcctatgtcctgaggcttctctgaattagaggctccaatgacaaggtcctgccaagagatctgatcttaggggtgaggtattgagaagaagaagaagtgaggaagatgggttttgaaagaggtacaggatccagaaataaacctcaccactttctccattttcctaggattgggtctatgtgaacaaacacgtttccatggttaactattcaactgaatacttctcctctggaggaattaaatctgaaggtgtttggttaaatgctttggggcctctatgtgactgtggggcctctgtgttcagagtctctaagcattaatgactctcagggatggttgaagtcaggaataacaattctgcatcctgatgatattgtaaagataccactactaaaaacgatgtttcattactattatttgtataatcattcattatttcaaaagcacgtctgtgcattctttcatttgatcttcccagtagcttcatgtggattgctaagaataagcaatggggctgggcgtggtggctcatgcctacaatccaagcacttgaactcaggagttgaagaccagcctgagaaacatggtgaaacccctcctctacaaaaaatacaaacattagctgggggtggtggcacgtgcctgtagtcccagctacttgtggggctgaggcgggaggatgcagtgagccaagatcgcgccactgcactccagcctagacccagtctcaaaaacaaaagcaaaaccaaaaacaaacaacaacaagaaaatcaactgtaataaataaataacagcaggagctagtacatgtagtgcctgacatgtcaggccttgcactgtgtcacatcagttatctcattcagtgttcatatcaatttgtaaagtagccgttattttttattcctgttttacagatgaggaaactgaggcacggaggttgaataagccaccccaactctcatagatattacatgagtaagtggcagagctgggattggaaccagagtctgtctgcctttgaaacctgtgctcccagttacaggtttcatggcctctctaggtatccaggcagtgaaggaaaaggggaataagatgcagtattccgggcagagggaaaagtatatacaaaggatatggacttttggaagagcatgactcattagaagagtttcatcctgcatggccaaagtagcaaggaaaaccttgaagaagatggcaatgattaaggtatttctgggttacagtgtgtcctttatcctagggatatgtggaaagtcacgagggggcttcctctggttagggttgtagtttggaaagctctctctgctctgtggaaagttgactgaatgactgagcttagagggagggagctgattaggagcctgttgtaataggcaaggggagagagctttagcagcacgtgaaccaagtctatggtaggaatgatggagaggaggggatgatgctgaagatgttagtggagacagagttgacaggacttggagattgagtggctgaaactcaccagggttaaggaggagcaaagtgtgagacttaggttcaggtctcagtgagtggatgggtcacagggttccggaagtggggaacccaggtgcataaactcatctgagggtgagcaaggaaagaagtttggggtgtcaatgagtcacccaagcagacatgtccactctcctgtccaggctgatcagtggctcatctcttctcaaagtagctgttgccgctgtggggcagctctcattcctcctgctttgatgcaaaacgtatccttatgattttcaccttacttctggttctggcttcaccatcaagtatggaaagtctttcatcctttatttaacctttcccagtgaagtttttcttcatgccacagcctccaagaagtaagcttgcaaacttgccttataaagtctctttttctgtctggtctggtcactcctgccctctagtggttagtgctagggcagcatggggctgggtacccacggggcctactgggttctatcccagcccgtcttccctgccttcctgtcttttcctaggctttcaccagaatccctctcatccgcaccttgtcttgccatcagattaagtttggcattggagcgatatcctgtgtcctgtcctaatgattcaagaggaaaagaccttgaaaattacataatccagctccccactttcacatctgtggaccaaaatgactacaacggccttctaacctgtctggctcctttcatagacacatcctctaggtctatttctacacagtggccaggtagaccagatatccctcttgtctctaaccctccaatggcttactttcacaattggcttcaaatcaaaattgatttcaacatggcccttcatgatctgacccctctctgcttttctaaacattctcttacaagaatcttgttctaacttcctgatggagctggccatccctctgttcttcaaatgtgccttgctttttcctaccttagtgcctttgcttatacacttctctctccccatcctttatgtttcagcctaaagatcactcctgaaagaagtgaaattgtctctgtttgctgatgacatgatcttaaatatagaaaatcctaaagattctacaaaaaaaaaaaaacctgttagaaccgataaacaaattcagtgaagttgcagggtacgaaatcaacacgcaaaaatcagtagcatttttttatactaacaacaaactaactgctaaggaacttaagaaatcaatttcattcacaatagcaccaaaaaatgaaatgcttaggagtaaatttaaccaaggaggtgaaagaccttcttactggaaactataaaacattggtgaaagaaattgtaagtgacacaaataaatggaaaggtatcccgtgttcacggattggaagaatgatatgtccgtactaaccaaaatgatctgcagattcaatgcaatccctatcaacattccaatgttatttttcatggaaataaaaaaatcctaaaatttgtatagaaccacaaaagaatctgaatagtcaaagcaattttgagacaaaagaagaaagctagaggcacttgaaatctattacaaagctatagtaatcaaaacatggtactgacaaatacacaatgaccgatagaacagcaaagagatcccagaaataaacccacacacttacaatcaattgaaatttgacaaaggtgacaagaacacacaatggagacaagacagtctcttcataagtgatgttgggaaaattggatatccgtaggcagaggagtgaagttggacccttatctcacatcatacaaaaaaacacctcaaaatagattaaagacttaaatataagacctgaaactataaaactactaaaagaaaacaaagggggaaaattccatgacattggtctgggcaattatttcttggacattgtccaagtgtctccaaaagcacaggcagcaaaagcaaaaataaacaaatggaattgcatcaaactaaaaagcttctgcagagcaaagaagcaatgaataaagatgcaacccagagattgggagaaaatatttgcaaaccatacatctgataaggggctaatatccaaaatatataaggaattcaaacaactctataacaagaaaataaataatccaatcaaaaaatgggcaagtaaaccaaatagacatttctcaaaagaagacatacaagtggctaacagatatatgaaaaaaatgctcattattactaatcatcagggaaatgcaaattaaaaccataatgagatctcacctcacacctgttagaatggctattatcagaaagatgtcagatacaagtgttggagcgagtgtaaagaaaagggaaaacttgtgcaccatgagtgggaatgtaaattttttgtctttatgataaaataatagaatgacattatttatttccttttatcaaagaagctaattgatacacaacaggtgacttggtttcaggcccaaaggtagcagcagcaacattaataatggaaataattgaatagttatgtatgtaatgcctgtcaccagaaggctatttcaagttcagcaggaatgactccatacatattattatttctataactacatttaagtcattaccaggaactgctttgttttgtagtgaaccttgaatatgtgctgttaatgtaccaaactggggaaaaaaataagggattcctttcaaaagttaagagaaacaagtgtgtaagaaattattttgtggctgggcgcggtggctcacgcctgtaatcccagcactttgggaggccgaggcgagtggatcacctgaggtcaggagttcaagaccagtctggccaaaatggtgaaaccccgtctcaactaaaaatacaaaaaaaattagctgggcgtggtggcgggcgcctgtaatcccagctactttgggaggctgaggcaggagaatcacttcaacgtaggaggtggtggttgcagtgagccgagatggtgccattgcactacagcctgggcaacaagagtgtaactgtcttaaaaaaaaaaaaaaagaaaagaaaatttgcctattaaatgttcagtatgtggcattctcttgtcagtaaaatggaaaaataagctaaaaataattggctaagtcctattaagttacaagattaagtgtattatattttcattcaaaattcggtgctcattaatttataatcggtagtatagctaaattgctatctttgtataaaaactgagcataaagttgctgataaatctctcagtatgaacagaagttgaaacctatttagttcagtagggcagctcagggatttttttacacaacatgtacatcttcccattttaagttagaattattttacaatagctggtgtacagaaacagctggcactggttgtcagctaaattaaagtagtaaggatcaactagtttttgttgatatctgaataacagcgttgtttcatagctttgtatttcctaaagaaatataaggcttctagctctttcattacaaattcgccctgtacagtaagttctttgatcttctctggattcttcacgtctttgtttttaaggaaaatgttgttcaaacgccgtttaaaatagtctgctccttttggatagtctcgtccaagatacagtagttttttttttttttttttttttgagacggagtctcactctgtcgcccaggctggagtgctgtggcgccatctcggctcactgcaacctccgccccccgggttcactccattctcctgcctcagcctccccagtaactgggactacaggcgcccgccaccacgcccggctaatttttttgtacttttagtagagacggggtttcatcaagatacagcagatttttataaagatttagtacttatcctcttaaagaattggccattttcatttatcatgtaaattatccacttttatgcataacatactttgcctccagaccccaggatcccggaaacggaacaaaactccccggcggcggcactcaagcaccttccactcacgcactttccggcacgccggagccgtaaaagcctcgaccgcttctacgactcttgtccttcgactgcgaagctggcttttttgagacagagttttgctgttgttgcccaggcttgagtgcaatggcgcgatttcggctcaccgcaactcccgcctcccgggttcaagcgattctcctgcctcagccccccgagtagctggtgctacaggcacctgccaccacgcctggctaatattatatttttagtagagacggggtttctccatgttggtcaggctggtctccaactctggacctcaggtgatccgaccacctcggcctcctaaagtgctgggattacaggcgtgagccaccctgtccggcgggaatgtaaattaatacggccattatggaaaacggcatggaggttcctcagaaaactaaaaatagaactaccatatgatccagcaggctcacttctgggtatgtatccaaatatattgaaatcaatttatcagagctatctgcactcccaggttcattgcagcattatacccagtagctaagatatggaactaacctaggtgcccatcatcagaggaatggataaagtaaatgtggtatatatacacacgatggaataccattcagccttaaaaggagggggaagctaggacccattggcttatgcatgtaatcgcagcactttgggattctaagcaggagaattgcttgaggccgggagctcgagaccagcctaggcaacatagtgagagccccgccccctaatttttttttttttttttttttaactagctgggcatcttagtacacgtctgtagtcccagctactctggaggccgaggtgggagagtcacttaagcctgggaggttgaggctgcagtgagctatgatcacaccactgcactccagcctgggcaacagagtgagaccccatctcagaccaaaaaaaaaggaggggaaaattctgctatttgctacaacatggatgaacttgaagaacattatgctaagtgagataagccagggacagaaagacaaataccacatgatctcacttgtaagtggcatctaaaaccattgaactcatagaatttgagagtagaatgtggttgcctaaggctggagagggggctgaatggggaaagcggacatgtcggtcagagagtacaaagtttcagttatgagagataagcccttgtgatcttttgcacagaatagtgactttacagtcactataatgcattataaataatgcattgtatatttcaaaattgctaaaagagtagattttaaattttttttccacagaaaatgatgtgtgtgagatgatagatttgttaattagcttgacttaatcattccacaatgtaaacatagcaaaacatcacagaaatatatataattattgcttgtcaattgaaaatgaaatttttaaaagtaactttctcagagaggccttctctaaccatcctctctgcaaaagtcctgccccaagtgaatttcgatgaccacactctgtgtattgtttacttgcacttaccctaaaccataaatgtttgtctgcatgttcatgattggcctccctttgccagcctgtaagttccactggggcctgtagtgggcagaagttacctgagaagcctttgactaacattggagtaggtcaaaagatggtaagaggtgattttttttcaaagtcagggaattcatatcaatggaaggttgaccagagttcctgaagaaggaattgttaaataaactctaagatcccttcaaccctaacattttaacttttccatctggtatttgaaaaatggaaggggctcagttccagtaatgacggcatagcctaagttgaactaaacctctcacagatgataatgataaactttggaaaaaatctttaaaacgatttgaggttgctggagaaaaacaaaaaatagacaggaggtggacaggatttgacccttgaaggaaggaaaaccacacccacttagtgaaatatacatttaggtggctcttcccacgccacctggcatggagcagctggaactcaagtggagagctgcagctttgctggtttgacaaatcagggggcagagtataagctcacagagtggctggaaaatgaggacatctaaagagatgccccaggtccatgtgcccactaaaatcaactggcacctctgttgaacctgtgatggttctgtctgtctctcagcccaaatctgcttttcattcctgcccacagttgttgagcatagatggaagcactgcctaataaacttcctgcttgcaagtcaccatgggagtgtcagctacctggggaattggacttgaaagcagtctaagtaatatttgtagagcattacacccagcaaccacaaaatatgcattctttccaagtgcatctggaacattcatcaaggtagactgtattgaaccataaaattaatcttaatgaacggcaaaggtttaaaaccttatagactgtgttcaagaatcacaaatgaattatattaaaagcattaacaagacaataattaaaaagcactgaaatttgaaaattaaatgcatgttttagtaatacatgggtcaaaaaattataagggataaacagaataatttaaaatgaatgataatgaaaatatgtcagaatttctgggagggaagcacattgctttaaatacttatattggggaaaaaaagagtttaaaattaatgatctgtgtttccagctcaaggctctagaaaacagaatagcaaattaaacttaaaccaaaagtaaggagaagaaaggaagtaataaaaaacagaaataagtgaaatagaaaacaaacaatggagaaattgaaaaggctgcaagttggtgccctgcaagagtaatacaatttataaattcttagcaacatggatcagtcaaaaagagagaaaaagcaaattaccaatatcaggaatatcaggaggaatcataagatcctacagaaaggatatgttatgaacaactttatgccagtaagtttcacaaccaagatgaaatggacaaaatgctcgaaatcacatattgtcaaaattgagataaaaagaaaaacaaaatatgaatagctttataaaagagattgaattcattattaaaaactttcccacaaagaaaaaccaaccccagatggtttcactgttgaattctgccaataatttaagaaaaaaaacacaatattacacagactctttcagaaaatagaaaaggagggaatgcttcccaacctattttgtgaggttaatattaccctgataccaaaacctagcaaaaacattgccaaaaaataaaaccacagaccaatgtttttttgtcatgaacatagacacaaaaatagcaaaatattatcagattgaatccaccaatatataaaaagggtaatacactatgatcaagtggggtttatcccaggaatgcaagtttggtttaacatttaaaaatcaatcagtataatttaccacattgttaagcaaataaatggtttcaaaaacatataatcctctcaatagatttagtaaatcacttggcaaattcaactcccaaatgataagaactctcatccaaataataatagaagagaactgcctgaatctaataaagtggatttaccaaaaacctctagttaacaccacattaatggtgagatactgagtgtttcccccctaagattcggaacaaggtaaggtgtgtgttttcatgatttctgttcaatattggaggtcctagctaggacagtcagataagggaaattagtaaaaggcattcagattagaaagaaagaagtaaagatctctatttatagatgacattatttaaatagaaagtatcaaggaatctataaacaactagtagcaacaatacttgaattgagcatgtcagtatattgaaaataatattatactagcagcaaacaaatggaaagtgaaatttagaaaacagtgtcattttaaaaacatgcaaaaaaccccaaacgaaataggaataaatttagcaaaatgtatgcgagatctctatattgaaaatcacaaaaaaatttctgagtagaggggtctactgtgttcatagagaacccaatattgttcagtgacaattctactcagtctatgcaatctcgaacaatattccaacagactttttcataaaagttgattttaaaatgcatatgaaaataggacctaggatatctaagacaatcttgagacagaaaatttaagttggaggactcactttacctgattttaaaactttctggaaagccatagcaatcaataaatgtaagaatagacagagagatcagtggagcatattaaacatagtccagaagtaggcccacacatgtacagccaattggtgccaacaaggccaccaaagcaatttagtgggagaaaaatactttcataaatggtgctggcaacctggataaatgaacggggctgaaaatgaacttcataccctacttcataccactcaaaaatcaagtttagttggatccccgacctcaacagaaaagctagaactataaagcttctacaagacactgtaggatggtatgattgtgatcttggggttggcagatttttttttttttttgggacagagttttgctccttttgcccaggctgaagtgcaatgatgcgatcctggctcaccgcaacctccgcctcccaggttcaagtgattctcctgcctcagcctcccaagtagctgggattacaggcatacaccaccatgcccagctaattttgtatttttagtagagacggggtttctccatgttggtcaggctggtctcgaactgcagacctcaggtgatccacccaccttgacctcccaaagtgctgggattacaggcgtgagccaccacgcccagcctggcagagatttttaagaacagacacagaaacactaaccataaatgaaaaatttgataaattaggtttcataaaaataaaagtttctgtttatcaaaacatctgcagatatatataagactttatatatattatatttatattatatgcatatataagtgtgtgtgtgtgtgtgtgtgtgtgtgtgtgtgtgtgtgtgtttagatacgtatatatgaaaggatatgtaaagtattcccagtacccaaaatacagaagtgtggtctcatcctatagtataatttttttttcttattgggatgcttttatctcaaataaacaattcacttttttaagagttgttttattctgccatacttctgctcatgaaggaaatgaagcagcaagccacagaatggtagaaaatatttacaatgtacgtatctgagaaaggacttgtatctagaatgtataaagaactcctacaaatcaaaaataaaaagataaacaacccaccttttagaaatgggccaaagatttgaatagatatccacaaaagaagatatgtcactggccagtaaacccatgaaacttgttcaatgtcattaaatatcagacaaaataaatttaaaacacaataagatactatgctacacccactagaatgggtaggatgaaaacgacgacaaccaaatgtgagaaaggatgtggaggaacgggaactctcaaatggagtgtgcaaaatcaaacaaccactatgggaaactttttgacagtttcttatttagacatacacttaccccatgacccaacaaattaactcctaggtattttcccaaagaaaagatctacttctcaatttatccatccatccattcatcatctatctatctagccccacaaaaagacttaaataaaaatttcttgcagcaatttatgcataatttctgaaaactgcaaacatttccgattttctttttcttttttctttttcttttctctctctctctttttttttttttttttttttttttttttttttttttttgagataaagtcttactctgtcacccaggctggagtgcagtgacgtgatcttggctcactgcaacctccacctcctgggttcaagcgattctcgtgcctcagcctccccagtagctgggcgtacaggcccacaccaccacacccagctttttaaaaaaaattatttttacttttagtagagagagagttttgccttgttggccaggctggtctcaaactcctggcttcaagtgatctgcccacctcagcttcccaaagttctgggattacaggtgtgagccaccatgcctgacctcaaatttttatcaacaggagaatggagtagcaatttgtggtttatccatccagtagaatggtattcagttattttaaaaatagaatgactgctatacaacatattgcatctcagaaccattgagggaagcagttattaacaaaagcataatatatttgattacatttatatgaagttcaagaacaggtaaaattaataaacggtgacatgcatcagaagagtatttgcctgttaggagatgtggagggaccagaaggggtacaaaagaactttctgaggtgtagaaatataataaacattataccagtatatacatttatcaaaactcaaagaagtgtatacctaagaactgtgcatttcaatcttaagtaaattttactgcaataaaaatactggctgggcacagtggctcacgcctgtgatcccagcactttgggaggccaaagcaggcagatcacttgaggccaggagtttgagaccagcatggccaacatggtgaaacctcatctctactaaaaatacaataattaggtgggcgtggtggtgggtgcctgtaatcccagctactttggaggctgagacaggagaatcacttgaatctgggaggtagaggttgcagtgagccaagatcgtgccactgcactccaggctgggtgatgaagtgagaccccgtttcaaaaaaaaaaaaaattgtatataataatcttaacaaaaaatataaaatctaattccatggtttaaatagtcattgttctcaatgggatgttttgatctcaaatgaacagtgtgggttttttaaacttatgttactctgtttagaaaagcaatagatgtgtatattatctgcttgtgctgacataacaaaataccataggctgggtgagttaaacaacaggtacttatttctcacagttctggaggctgggaagtccaaggtcagggtgtcagctttgcctggttctggtgagggctctctcctggtttgcagatggctgccttttacctttgctttcacacagtgcagggaaagcaagctctctggcatcctttcttataagggctgtacttccatcgcgtgggccacaccctcatgaccccactaaccataattacctcccaaagggctcatttccgaagcatcatattcagcattatcttcaacatataaatttggtgaggtgggggacatgccggtccatagtaataagcactctagaaaattagaaaaatataagtaagaggaaagaaaaagaaaaaaaggcatgtacttgcgttaccaaaatataatcactgttaacactttgatttcttttatttccaaagttttgttctttcaacttgtacatctttgtagtcatttggttcctataattttgaatcattatcttttaaatttgtcattagaacatgaaattgtttctgttaccaaaatccgttcttcagggcacctttaaaaatagccacaataggttcattgagtaactgtgctgtagttgacttatttgttaaactgtggttgaatgttgagatacttcccagtatttcgctagtgtaaataacctgtgattaacatatttgtgcatgaagctttttctgtaacttagaatctttctttgcgatataattccagaaaatggaaattgtaggttaaaaagctatcctcttaatacatgttgccaaattcctttccagaaggatgtcctaatttacattaccacctgcagtggggcaggaaagcgctgtatctgtttgctcttaagggggtggaggtcgtttccacttatgtatttgttggcttatttccagcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtaagtaggaatttgcaagtgctaccaccttctggggcaagagaggagtggggattatctcatctcctggggaaatagaaggggagagctatgagaggcttgggtgctatcagagcctggctggagagaaggaaactaacatgtaccaagtggctgctgcatgctaggcccacagcacctacttagtgccacattctcttctaagggctttatatttacaggtccacagtccctcgcctgcaaatcccaaatccaacacactctggaaactagaaaatgttttgcaattcttttggtagcaaagcctaatctgcaggaaagtgaggctataattatactaagtgtgtttgttcatatgatttgctgcaagcatctgaatgtgtttgatatggagtatagttcagagcctgctggaagtgttatataaaatatggtatattcaccatattaccttcctaaaaatggaaaacttttaatatctgaaatacgtctggcagtacttggcagattaacctgtcagcctcagccaccctccttccataaaatgagcttgttatgaggataaaagaaagcaatacaagtccacagtccttatcccaaaccttgggatcagagtgcctgagtgtgcatctcagctctcccaggtactggcagtctggctccagagcctgtcttctgaacaccaaaggtgggcagaaatgaccactgccagcctcttctcagacagtgctccctagctggtaagttccacagtggcagagacctgatacctgtgtcaagatcactgtagcagtcattcaccaggtagtttactgagcactgattcggtgccaggcatagctgagatgcatgggtatagtagggaacaggctcctgcttatgtggagctgcatttggagaataagtctatcccagctgtttggtactcagaggtgataaatgttatcagtctagctggagacatagaaattgcagttcaggaagtgagcccaactatggagatggaagcattgcatccagagcagaggaatacatggatgggaaccagaaaagtctgacagtggactcatacatggcttttggggatggagaacagggtcgcatgtgcatgtctccaaaggtggccacatagtaggtgtatcagtctgttctcacactgcctgaagaactgcccgagactgggtaatttataaaggagagaggtttaatcaactcacagttccacgtggctggggaggcttcaggaaacttacaattatggtggaaggcacctcttcatagggtggcaggagagagaatgaatgagtgccaggtgaagggggaagccccttataaaaccatcagctcttgtgagaactcactcactacaatgagaacaccaacgtgggggtaaccacccccaggattcaaattacctccctctgggtccctcccatgacacatgaggattatgggaactacaattcaagatgaaatttgggtgggtacacagccaaaccatatcattccacccctggcccctcccaaatctcacatttcaaaacacaatcatgccttcccaacagttccccaaagtcttattccagcattaacccaaaagtccaagtccaaagtctcacctgagacaaggcaaatcccttcctcttagaagcctgtaaaatcaaaagcaagttagttacttcctagatccaatggaggtattggcattgggtaaatacacgcattccaaataggagaaattggccaaatcaaaggggctacaggccccatgcaaatctgaaatctagtgaggcagtaattaaatcttaaagctctgaaataatctcctttgactccatgtctcacatccaggtaactctgatccaatgaggtagtaattaaatcctaaagctctgaaataatctcctttgactccatgtctcacatccaggtaatgctgatgcaagaggtgggctcccatgaccttggatagctccatccctatagttttgcagggtacagcttcccctcccagctgatttcacaggctggcgttgtgtcttttccaggctcacagtgtgaagtgtcagtggatctaccattctggggtctggaagacagtagccctcttcttacagctccactaggcagtgccacagtggggactctgtgtgggggctccaaccccacatttcccatccccactgccctagcagaggttctccatgagggccccacccctgcagcaaacttctgcctggacacccaagtgtttccatacatcctctgaaatctaggcagaggttcccaaacctgaatacttctgtgcatccgcagggccagcaccatgtggaaggtgccaaggcttggggcttgcaccctctgaagcaacagcctcagctgtaccttggtctcttttagccacagctgaagtggctgcgacacaggcaccaagtcctgatactgcacacaggagggagggccctggacccagcctatgaaaccattcttccctcctaggcctcctggcatgtgattggaggggctgcccccaaggtctctgacatgccctagagacattttccccattgtcttggtaataaacattcggctccttgttacttatgcaaatttctgcagtgggcttgaatttctccccagcaaatggatttttcttttctatcacattgtcaggctgcaaatttttcaaacttttatgctctgcttcctcttgaatgctttgctgcttagaaatttcttctgccagataccctaaatcatctctctcaagttcaaagttccacagatctctagggccggggcaaaatgctgccagtctctttgcatagcaagagtgacctttactccagttcccaaaaagtttttcatctccatctgagaccacctcaacctggacttcattatccatatcaccatcagaattttggtcaaaaccattcaacaagtctctgggaagtttcaaactttcccacgtcttcttgtcttctgagccctccaagcctctaggaagttccaaactttcccatattttcctgtcttcttctgagccctccaaactgttccaacttctgcctgtcatccagttccaaagtcacttacacatttttgggtatctttacagaagcatcccactctctggggtaccaatttactatattagtccattctcacactgctataaagaactacctgagactgggtaatttataaaggaaaacgggtttaattgactcacagttccacatggctggggaggcctcaggaaacttacaatcatggcagaagccacctcttcacagggtggcaggagagagaatgaatgagtgccaagtgaagggggaagcacattataaaaccatcagctcttgtgagaactcgctaccacaagagcagcagcatgggggtaactgcccccatggttcaattacttcccactgaatccctcccacaacacatagagattatgggaactacagtttaagataagatttgggtgagtacacagtcaaaccgtatcagtaggcaccaagtaactatgtattaactgaataaatgaatgcatcccattcattaaatgtgccagatgctctgttagtccaatgtgcatgtatatacactcattcactccttgagacattaacttagtttgggaatgattaaatctatgctttgctatttatagttttttttgttttgttttgtttttttgagatggagtcttgctctcttgcccaggctgtagtgcagtggcacgatctcagcttactgcaacctccacctcccaggttcaagtgattcttttgcctcagcctcccaagtagctgggactacaggcaggcgccaccacgcccgggtaatttttttgtatttttactgtagacagggtttcaccatgttagccaggagggtctcgatctcctgacctcatgatctgcccacctcggcctcccaaaatgctgagattacaggtgtgagccaccgcacctggtgctatttatagtttttaatgcatactctatgtaaagtcaacattaaagtatgttcagcagattcagaccatcagtctgactttactgcttcctgctcagaaattgcctcttcttaaccagattggtcatgtgaatcacctgtcttccgatccagtgtgaatcatcttaggtgttgctgcttgcttaagggtatttatcatgaaactttgtttgtctctgcttatgtgtttatgtaaagcatcactattaggctctgagcttagtggttgatgtctgccggggtgtttcttttaggccctctgccctgaacaatgcccatctgcctggtagtcaaaatgcctgcatggcccttgaagttttctctctctcttcatcccaacatttgaccttgattttgagtgttctctgctagctgtgttatccctggctcagctgtttgtcagggaagttacgtctttgcatggaggttgaacttaataaatggcagtatggtgcaatgttaagaatacagacatcagagctaggctatctgggttgaaattccatctctaccctgaagtgactaatgacctttgtaaattactgcacctaaatgggaataatgatagtacctatgtcatagagttaatgtatgtaagtagggttaagatctgagttagtataacagtgcatgggatgtgcctggtagacagtaagtactgcataagtgtatattattattgctgactattgtgatccttcctgtgtaacattaatcatcttaacagtagccccttgtaggcatgcctgtttaatttcttcatgccaaatatacagggcagtctggattaggatttatcccattgtgctatttatttaacccattggtccgttggtcactcttccctgtaggtcctgggtgataaagttgggtcttattaatatctgtccctccagtgtccatgtggtatacagtagggtaggggaacagtgaatgaggttgaaatgcaatgagtggcctcagacataacatttaaattttgaatttgatgttcagtctctctattccacaggaaggaccagtgtgtgaattttaggctgtgtgcaagggtagggacacagctttggccagaggagtttttcccaatatatttcaatcattcgtcctatggccacactttaattgggactcaacagtctttgtttatggtgttcttgcccctcagtgggtgaaaaaggggagaagtaagaaactaagactcattaactcatctggcagttggccctgcaattattagatgtttgtgacagagacttcctaccaccaacatacagcttctcccacagaactccatcctagattcttcacgaacttcctaacctctctgaatcgcaacactttcccggctttctccaaattgatgctgactgccttagagtctcggtcctgtcctgaagaatcccggaaaaatgcctgtcccctgccaccaggagcggccagcaggtggcagggcagccccacaatgcctgggtggttctgcagagtctggtgcctctgggccagccccctccccagcccctcctgcactgtgtgagctgtctcccaggggaggaagtggttaaagggaagaagccagctcacagggcccccttctttcccctttcagatgataatgaaggggagaggagctgcagtctggacagacagtgaacccaccccaaccccaacggggacgatgatgctgcccccttttctacccttctcagcccttctcaggaagacagacgtttctctgtcttcccattcctggtccagggccttccagtagaatcaggttttgttgtggacaggtggggtaattgcaggataccactcttccctgcctgatgtgtccagcttgtagactctgagtcagcctgggtcccttgaggacgatccaaaacctggccagtgacctggagagagacctttcatcttcaggagaaatagagggtctcaaagccgtctttgctgggagaactcatggccaggcatttaaagatactctctcctgttgggggtgcctgaggagaccagcctggctaggcaaggatgtaaggcctggctccggataggtctgaactaaaggtgatgctctcctctgggatggtgggggacaatcagcagtttgtttgtttttaaatgaggtggggtttcactgtgttgcctaggcttgtcttgaactcctgggctgaagcgatcctcccacttcggcttcccaaagtgctgagattacaggtgtgagccaccgtgcccagcctcatctgtagatttgagaaccacaagggaaaggagaattataattaattgatatcaaactcagttctcttcagccccactgccactccactgcttatcttgcctagaattttccagcagcttcactggtctgaaacctcccatcttgagttcaccttctggttaccttccatgggactacccaagggtcatctttctgaaacacaaatctgaccagtttcactttgctcctgcctgccccctccccatgcatctcgttttattaatataatcctgtggtgggggaatcgttgccctcaaagtcataagcatgcctgccctgccctccctctagttctgcctccagctctgcttcctgtgcttttattgtttgtttttgttttgttttgtttttgttttttagagacagagtctcattgtgttgcctaggctggagtggaatggcgcaatctcagctcactgcaacctccacctccgaggtttaagtgattttcatgccccagcctcctgggggtctgggattgcaggcacaggccaccacgcccagctaatttttgtatttttagtagagacggtttcatcttgttggccaggttgatctcgaactcctgacctcaagtgatctgcctgcctcggcctcccggagtgctgggattataggcgtgagccaccgtgactggccctgtcctgtttattctgcaggaagagtaagccacttgtagttctcaaacacacctttccgccttagtacattctgttccctgttacctggaatacccttccctatcttgtacacctggcaagtttccattcatgtttgaaatcctgctcaggtgtcccctcttctgagaattcttccctgacacaccccaccctgcagtgttaatatcgacctcccttgtgtaacttaaaacacacttcatcatgctggcgcatcatgcaggcgcacataccacactgtatctgtattataatcgtctcttctgcaagaacaaggcctgtctcttactcttcctaatgtccctggagctcaacacacagtaactgttcagttagcatatgtcattgccctaccttagtccaagcaggataacttgtactgggcatagtggagtctgaagctcacctcaccttagggttcaggaacacagaacacacggtggaggagtttctatttttattcacttctgtataaaatcttggctctttacttaccaggatgccagagtcactgtaaggctgctatttgaaattgtttttaaaaaggaggatggagggacttttgtttttttttttttttttttttttactatttctatagaatgtaccagaatcccaggtttgattttcaaaatcaaaacctttaacatgacccaaaaaataaaaaagacaggtggagttggtgtacctccctgccctcagtttatcctacaaggtctctggagcctggatagaatggggaggagggctgttgggggagcagcgaatagaagctgttcctccccaggtcactgcggtcctccctgggtggcctctggagccctggctctcctgtcctcttactctgctggtagcctttttctcagaaaatctgctcttccatttccgcaatgatctattgctatctttgctgttattgcccacccttcccaatggtttcttttttcttttatttgttgggtaagaaattaaaagggtgtccttggtttgaaaccctctgaaaccctcctcagctaccatccatctggtggagagaatatcagactacaccttcctaccaaacaaggattaatgacacccattggtaagcaccttgtgcatttctagattttccaagagttattacgctgtatgatcatcacctatctgcccacccacttctacatggtgtctgtatttgcccatgcctagaacagggcagataataggtacgtaggaaatgcctgttgactgaatgaggaatttgggaggtggtgcgttattggcaatgacaaggttgggggtgtgacaatcaaactgaggaatgacattggtggcattctttttttttttttttttgagatggagtctcgctctgtcacccaggctggagtgcagtggttcaatctcagctcactgcaagctccgtctcccgggttcacgcccttctcctgcctcagcctcctgagtagctgggactacaggcgcccaccaccatgcccagctaatttttgtattttttagtagagacgggggtttcaccgtgttagccaggatggtctcgatctcctgacctcgtgatctgcccgcctcggcctcccaacgtgctggggttacagacgtgagccaccgcgcccggccggtggcattcttaaaattctctttttccctctcaccttgactcaatccagctgaaaatcacattggctgttgtgggagcatttacactgtggaaactggcaaatgctagaaagcagggctttttgttcccccatccagagaactggttgttaagcatttgccgaggagcaggagttgactgtcagctcatttaaaggtgaggggggcagagcgtggagaaaccatgcacctgctcaaggagacagaagtggggctgggctgggacttgaactggactcatgtcgtaaaaggaatttctgatggtgccaccctcctgctgaccactgctactgcttcagtgtgtggcacgagatagatgctgaagagtgttggtcaaatgactgaacaagcacatgaatgacagagctctttgaggatggggtcgtgtctgcatcatcatcttttggcaagcatctgtgcacgtcccctgaccaggggttcaatggctttcatagattctctaatttagctctcccaataactgtatggggcaccagtactattctcattgtatacatagggaagactgaggctctgagtccaaaatcaaagcaaatgctactgacatctgggacctggctcaggcccatccaaagggctagcctgggcaccgcagttcttatgccactccccaacctctcccacctgaagctcagcccctcctctactgctcctgagggtgttgacctcggggagcaggaccctggggcctcacaccccggcacacacccagcgtctgagagcagtgtgaggcaacgggtggcagcactccatgttacagtgcacagccaagcacaggattccggtgacctcaccctcagaagaaggcgccccacctcgagccaggcagccccgccctgctggagccctccgggcagccagagcttaaagggtgcccagggaaaagggaattcctttagccatacacatacttacgagttcaggtttgcaaattggaccttctacagaaattgtccttggatgtgcagagaatattttcctctttttaaagcaccaagggatctcaggcaagatcttttctattctttcccgtatgtttagatattaaagatgtgatttcctaacacatgtcagacatgattcccgagagttaaatgggaaagaagataatactcaagagaactctaggctgacaggtggtagcgtgggcttgaagtcccagccactcactgtctctgtggtcttggccaagatactgtaccttttggtacctcagtttctttgtctgtaaagtgggatcacaatgccaccaccttccctataccactgacttcacagggatgttatgaagtgtccagtgagagtgccgagttcctctcctccacagctgtttttcagtgtgggtgcttagtttttcaatgtagatgtgagtgactttgtttggtcctacccatattggaccaactctgactcaaggtcagagtttatgcctttcctatgcaaccactgaccctcagagcccagcacagtgcctggctaggatagatggacgggaggctgggatagatggatgacttaaggaatgaatggatactcttgccaaagtctgttaccattattaagggtaaattcaggattgaggatgccctggaagagagtcttagaaaatattcagttgccctggaattcagggagagtacctgatacttgcatgttatttccaaggcttcccctcctccttctggtgcagctggtaactcagaggccagtgtttccttcagggggaaaaaaaaaggccggatgcggtggctcacacctgtaatctcagcactttgggaggcagaccacaaggtcaggagatcgagaccatcctggccaacatggtgaaaccccatctctactaaaaatacaaaaattaactgagcgtggtggcgcatgcctgtaatcccagctacttgggaggctgaggcaggagaatcacttgaaccagggagtcggaggttgcagtgagccgagatagtgccacaacactccagcctggtggcagagggagactccatctcagaaaaaaaaaaaagcagcttcagtctgctttgaccgaaggcatgaggactgcagggcatcttggcctgtccttgtaaggactgcattgggtttgatcagccctgtggtgatcaggacatgctgcgtccacctgtgccacgtggaggaaggatggggggtgaactcagagctggcacaaccagcagtggcttggggtagggttgtcagatttagcaaataaaaatacaagacacccagttaatacttagatagacaatgaatgagtctaagtatatcccatgccatatttggagagacttatactacaaaatgatgtattgttcattggaaatttggattggatggaaaatttggatgtcctggattttatctggcctctctgcttatggagggcagcaacaagagacactgctggctctgctaccacggggccagtgagaggttggccttagagcttccttgttttctggctgggaagagccaaaccagatccccctattgaccccattctcagagagcagctttccttgcctgtgaggagggctgtccgccaccagcagggagggagggagcaaagctgaggggacagtccagagccagacggcctgggtactgtgggctctggtccctgttttccttctcagttatgtgaccttgggcaaatccaacctccgaacctcacattcctcagcaggaaggcagggtcatggaatatcttcctggaagggtaactggaaagattagagataatgacatgggtggagctggtacacggcttaggctgtcctaagaggccctgaaatggtaactgttattaacaattaattgcaattactaattgctggtgagtataatcgttgtggaagccagggggaaggaagccatttggcctgcctctcagctcagctggatgtgctggagggctgtcttccagaaaccctagaggagggtgtcgagatcctggcgggctggcagtccctccgctgtgaggatgaggtgccgactccaagtcagtcccctcctcctagagttggttgagaggcttagagtggagacacacaactctctgttgaagacacttggctctgaggaacaaaatccttgtgcctctctccaccgcttcccctacccctaaggctctccttgaacaagggcaggccctgcctgtttgtgtggggaaatgaaggggtttctgggatggctggaggggctgggggtggagataggaagggcctaatgaagggagttttgtcactttctgcttgcttcattccatcactcaaacacaccacccaacaccacctggaggggctctggacttcattcctctccctctgggcacccacgctgcaccccctgcccctccctaccccctcgcagtcctggccctggtgtctgggggagggaggggtcctgggcattcctcagcagcctaccccgtcgcctggagacagctccgttttcccaggcccggccccttttatcagggagacaatgtgcacacagtgagggccttgtgcggcacccaagccccgagccctttgacttgaggaatttttcaagtgctgacccctctccgtgaggtctacacgctgtccaatccagcggcccggtgcccctgctgcttcctacccagctctttcggggaggaggggggaacagtgaagagttgttacccccgccctagtggagtcttaggggagagcttcaccctcggaaacaggagctagaaaatctgggggaaatggctttgagcagaagagagtgtggggagaaatctgatgggtgctgtttcttcctaaatttctctcttcttggctgcctttctaaagaactctgcagatgctgtggggtcttgaggctggtgctgagggatcaccttctctggcctctgtttctcctatgtgaaacagtgaggttggcctaggagcatggcccccaaaagactttctatcacaatgacattcagattcccaggcaccatctacaccctctgtgttggatacagttctttgcatgaaaaagaaatagactttgggccgggcatggtggctcacgcctgtaatcccaacactttgggaggccaaggcgggtgaatcacaaagttaggagttcgagaccagcctggccaatatggtgaaaccccatctctactaaaaatacaaaaattagcagggcgtggtggcggcatgctgtagtcccagctactcgggaggagaatcacttgaacccaggaggtggagtttgcagtgagccgagatcgcgccactgcaatccagcctgggcgacagagcaagactccatctcaaaacaaaacaaaacaaacaaacaaaagagatttattgaaaatgtatggggaagcttgcagaagcaaaggaaaatagggagacctgagtgtcagaaagatggggctgttgggtccctggatccccgggcccctccacagatctaggtggcaggaacagtctcaggatacatcagcttgagtgtcagaaagatggggccattgggtccctggatccctgggcccctctacagatctaggtggcaggaacagtctcgggataaatcagctcctgcttgctttcatccttgtttctctctgttcaaaaatcaaattcctggggaagaacaagcccggcttgttctactccttgctctgcgggcactttgggacagtcccaccaggactgcacaaaaagaaggcttgcttccatcaatgcaaatgcaaatagaactgctgttaccagaagaaggcagaatggatacaggacaggccacacggagatgttcccctgcaatgatggaatcagaatatctagactggagctcaggagatgaatttatttttatttttatttttattttgagatggagtctcgctatgtcacccaggctggagtgcagcagagtgatgttgcctcactgcaacgtccgcctcccaggtttgaacaattctcctgtctcagcctccccagtagctgggactacaggcacataccaccacgcacagctaagttttgtatttttagtagggacggggttccactatattggtcaggctggtcttgaactcctgacctcaggtgatccaactgccttggcctcccaaagtgctgggattacaggcgtgagccaccacgcctggcagagatgaattttttaagtggtgtaaggccaagtttagaaaccccccaagctagaggacttgtttcatgacgctcccacctggtagaactggaaccagtgggggagaacaaagagggagacatatttaagctcagtatacagaaaattcatctaattggcaaagtcatccagagactgagtgggcttcctggtgagggaatgagctcccctcaggtgcaggtgttcagacacagctgggctacccatttgggaaaaataatggggcttagaccatgaaagggtcaggctgcaagcctttaaaagggaggctcggccctgaagtcttttgttttctctctgatgtcttctctatcacttctcatgcccttgccttgggcaaagtctgaggagtttcagcgtttcacttgtgagtcgtgttttctcctccacaacctggttttctggcccaggccctccaagtgaccttttttccaaagagtccctcggatgcacgggtcttcttgagcaatagctactcctggggtggagtagatttctgcctgagttacagccttgccctgggggaggcagggctctgggcagatgccagcctcattacagaacgtctaggaagcccttggggcctgtggaggcctgcctgggacgtgcatcttcgacaggagagaggccatctgtggtggcaggagaagggatggtgcttcatttccattttcctgactttctgccctgggtttgcagaagggacaggagtgtgggtttcctgaagatttgcactaagctaattgccatcttcagaataggcttagcgaaattaggggttgtctgtgcagctgctcagaggggacaaatcagtccgtgagtgaaggggcaggtggtaggaaaaagcacaggcatagagaaatatttccctgctataagaaaaacagcagcataggctctatgacagatgatatctgccacttggcttcggctgcagagagatgacagggagcactgggaactgtgttgggcgtgagaaccgatgcctcctctgaggcagcagctgcaggccccgcagccagtttttaccatgtgggaataagggcctggtgttgtcgagttattgattttcaagaaaagtcagaaatctgaatttttatatgaatgttctattattactattattattattattattattattattattatttgagatggagtctcactctgttacccaggctggagtgcagtggtgcaagcttggctcactgcaacctccgcctcccgagttcaagctattctcctgcctcagcttccccggtagtatgcaccaccatgcccggctaatttttttttttctttttttgagacggagtctcactctgttgcccaggctggagtgcagtggcactatctcggctcactgcaacctctgcctcctgggttcaagcaattctcctgcctcagcctcctgagtagctgggactacaggcaccacgtccagataatattttttgtgttttttttaggagagacaaagtttcactatgttggccaggatggacttgatctcttgaccttgtgatctgcccaccttggtctcccaaagtgctgggattacaggcgtgagccactgcgcccagccaattttttttgcatttttagtagagatgggttttcgctatgttggccaggttggtttcgaactccccacctccagtgatccgcccacctcagcctcccaaagtactgggattacaggcgtgagtcaccttgccagcgaatattctattttaaaagtatacaatttaagtgcaacaaaacaagactgtggattctatgaggtctactagttggcagcttctgataaagaagacaggagtcagagtaactatttggtctagttcctcttctgggactatctcctggctagacagtaaaaaccaggatggcaagggggctgttttgttcagtgcaatttcaagggcctatgtagcacagtgctgagaatatagtatgtcctagatggatggatatgtggatggatgggcgaatgtgtggatggatgggtagatgggtgggtaggtgggcggatggatggatggatggatggatggatggatggatggatggatggatggctggatggatggatggatgggtggatggatgcatggatggatgaatatgtggatggatgggtggatggatggatggatggatggatggatggatggatggatggattcatggatggattcatggatggattcatggatgggtagttgggtggatgaatggataataaatggtcttagcctctcttttggtgctctgcacttttcaccttgacaggctccactttcccttgccaaacaagacacacaatatccccgtgatccccttatcctccttatgccatcaaaaacccttttctgggatgatcagatgttagtcacttgcaccttggcatgaattactttttagtatattacctttcctgtggggatttccccagttgggcccttagtagatgctcaataagtgtttgctgaaggcatgatgtagccttccaaacgttaaccctttctgtggtatgaagagtgtgaacttgcagacatctgtaggaatgagggtgacatagtgctgtgtctttagagaggagaggggtagagggagtgggtgtttgatgcctttttttttttttttttttgaagatggagtctcactctgtcacccaggctggagtgcagtggcttgatcttggctcactgcaacctccgcctcctgggttcatgcatttttcctgcctcagcctcccgagtagctgggattacaggcgcatgccaccatgcccggctaatttttgtatttttggtagacacggggtttcaccatgttggccaggctggtcttgaactcctgacctcaggtgatccacccgcctcggcctcccaaagtgctgggattacaggcataagccaccgtgcccggccctgatgactttatttaccctaaaggcctatgctggagaggaagggagttcccagggattagacagggaaggtctccatcatgctcgacaccaagcaaggtttcatttagagcaaggcagatgctgccatctacctcctcttggagagagaaaatgacctgtcatgttcttagggacatacccagctgacctcgaccctccacccatcatgctgatgcacaggagggaaagagatgaacattagttaaacacctgccatgtgtcaggggtatcattcatggggtccttacagcagatatagtaatgtccttatttttacagttaaggaaaccaaggttcaggaaggttgacactggcctgaggcagcactggaaataaatagctgaaagggacctgggcttgtctccaaggctagtggtgctcacgcacttccttacctggggagatcaaattctacccttgcagcccatcggggagcagctcatttgctagcacattcttggcaggttacagaggcccttaaatctgtgtcttcatataatcctgttgacaacatgtgagtagatcttcttatccccatctacggaagaggaagcagaggctggtccaaaatcaggcagcaggtgccagagctgccaactcaaacccaggtcttctgctctgtgcctgttgtacattaaaggacacacccaggaacattcatttctctcctgggtgcccccaggacgtacctacttcctttgcccttgcccgtgtccttttggcagacacacacatccagatcctgctgcactcatctttgcagccctggcaaagactaggtaccaaacattggatggatgggtggacggtgacctcaggaaggtgacccctgaccttcagactgagttggctgctttttctgtgggctgagggggatatttgtgtgaatgctctgtgtggtcattttctatttttgtgtctgtccctcccattaggtagtaagccccctgagaccaagagctagctatgttgtctttgcgcttgtttccttaaagcctgcagactctggcacatagtaggtggtctatctgtgtatgttcagcgtctttgaaagaagccttttctaccaactgaagtccaatttcccctgcaccccacatcttatcctcaatcacattggttgtgcattttattcatagtacttttctttttatctatttattttattattattattattattattattattattattattattttgagacagagtcttgctctgttgccagactggagtgcagtggcgagatcttggctcactgcaacctccaccacccggtttcaagcaattctcctgcctcagcctcccaagtagctgggattacaggcatgcaccaccatgcctggctaatttttgtatttttagtagagatggcgtttcaccatgttggccaggatggtcttgatctcttgacctcgtgaaccgcccacctcggcctcccaaagtgttgggattacaggcatgagccactgttcccggcctcagtgtctttcaaagaagccttttctaccaactgaagtccaatctcccctgcaccccacatcttatcctcaattccattggtcgtgcattttattcgtagtactcattctttttatctgtttatttatttattttttgtcttttcaataagcatgtaagctctccaagaacaaggactacatctgccactgtatctgctgtatctactcctatgcctggtgtggtgcctagtccacataaggctcaataaatagtgattgaatgagggagtgaataagtgatgtgaattgtgatcagatcctgcccacaaaaatctccttctctattgttctcagaggcaaaaggtggggatcatttgtcacatcctgtggctcggggccctgttatgtctcagttttttgcctccgcagatccccatacaggcatagggagtctcatcactcttagtgcattccttcccttcctagttcattggaccttgctaattgcatggaggactgagaggctgcaccattgtttgcggttgagggggcggttcctccctctggcaatgggaaggtgccaggagggtgagctgttctcaggagaaaacaatggagctagaatcagatcttgggtccctttgcgttccaaggtctttcttctgccacatctctgcccatccagcctgccacgtgactctcttgctaactggcaaagtctctgagtgttttgccttcattttctgcacagcccattggttgtcttccctgcttctgcctgggccacaaatcagcaactgacatgttgcatcagaaacatgaaaatctctttctctatttccactccacccccagtgggggtggcctgcggagagacagctgtccctgggacaggacattcctgacctctccttccttggaaggacatcaccaagccctggctgcgttaactctacatacaggatcgatttattggaaaacagtcctgtttgaacacagatcctgtttgtatgaattccccttcttctgcccctgctgcagccacaaaagagccccatacccattcctcatcagtctctctcatacacacttcccacctccctcaactagggatttcccaccccaggcagcaccagttttataatattcttcttcctggggcctcagatgtggcagtaaaatatgagaccacccacggagagagaatcttcgtggaatccagagctcccccaggccaaggacttgattgattggctgaggtattcagggagcttattatgagattgaacatattagggtgggaagaggaggcagccatgagagacagagcccttaggcacagcgggtccatccattttgcctgaggtcaaacagccagtcaattacagaggcagcaaccccagcccccaaaggcatctagaattccagaccatccctacccttccctctgccagacagaaccgttcagaggcggctgaagcctgaatgagcccccggcaaggaggcagcagtctgtgtggcccatcaggagacagacttctgacttgcagccaggcggggggatggactccctgaccctcagcttcagccccagtccgtctgccaggccctgcagtaaacattccagagatgggcaaaacaaatgtttctcctgggaaggtgaggtctcatcaagaccacagctgcttgggtggtattggtgtagtgcaaagtgcttcaggttccaggttagaatcaagtcgaggaatgccagttgcgaaggttggcctcgtacacacccccacatcgcagtggctgtagacctgtgactgtattacaatggtgtgccagtagatggcagtcaagtgtctccaggaaaggccggcctacagacagtatttccttacccggtcagcgaacatttgttaagcctgttgtcctgtgccctagctcattgtgctggatactggagacacagtgagcatggagactcagtttctggtttccaggagctcacagactatatgtttgggggcagagggcagctaagtgatgtgtaatgacaacgtgaagtggtaagggctggaatggttgtaagtgcagcgtgctgtaggaaccaagggaggacgctcagcccagctagggaagggggtgctgtcaaggaaaactcagcagagtagatatcactcataggatcttgaaacatgagaaagagacaatcaaggaagtgccaagcagaggtgaaggcctgtgcagaggttcagaggcaggacagcacaggagtatttagagaagcacaggaatttggatgcaaccatgaaatagacagcaaactggaggggaagcagacccccagtcagcagggtccagatcatgaaggacgccagggctctggactggatccaaaaagtctgaaagaccacttagggtctccaggaaaggtacccaaattcttccctctagagtttgggtacccagatcactcgtgtgactttgagcagagacttctccatctggaacacgttgggagcaatccctgccctaccacccctcagggttggcatgagggtcaaataggaggaaggatgtgaagggtctggctgtccttataggccaaggccacctcttttccccatcaccagccatcactccttgcacctgtgagacagatcaaagcaaggtgagtcataattctgctttggaacccccaagagggtaagattgttttgtttatttgtgggtccccagcacacagcacccactaggcacagggtaagcactcgatagctctttgctcttgtggattctgtttcaggccatggactacatactttgcagcttactgtgtgccaggaactattctcagtgctttgtatgccttgtttcatttaatcctcataacaaccctgtgaggtggctactactatgagcctcatttcctaggtgtggaaactaaggcattcagaggttggcttacccaagcttgcacaagtgagtggaggagttggggtcctatccaggctgtatgccctgaagccattgcactttactgccttgttgcatagaggattatgtgactttctcaccacacccttccctggtagttactgtcaccacttgacaaatgaggaaactgagacccagagggctaagtgtcttgtcttagaacacatggtcagtgagtagtagagctaagattttgcccaagcctgtgtgattgcaaatccatgttttttttcccagtatgctggtgattgtaatgataggttaccattcccggtcccaggcccacccagtacttcttttaaatttggagcttggatttaaaagcaagtgatttttaaatccacgaaagatgcctaccttggatcctgctctggtccttattagccacacctctcttgacaggcagaggagttaggagtgaggggatattcccaccaagaccctacaaattgcactcttaggccatgccctgggtacccaaactctagaattccctcctcaaagggaccttaacccaacttcagagcctatataggccaattccttggtccattttccaaggggtggccaaaggacaaccatttggggaggggaagggagtagatgaagcttggccacgtggtctgggcaatccacatacccgcaccaggagcctcagtggtgcagaggagagtgggtggggaattaaggaagatcttgggtgaggtctgagaaccaagagctggcaatccttgtgctgccacgtgctgggtagagtgcaaagaattctgagaagtttacattctgagtctttaaggtcattatgaaattgtatctgccaaggaaggaagacagactctttgggactctttttttcttttttcttttctttttctttttcttttttttttttttttttggatggagtttcattcttgtcgcccaggttggagtacaatggcgcaatcttggctcactgcaacttctgcctcccaggttcaagcgattctcctgcctcagcctctcctgcctcagctggaattacaggcgcccaccaccactcctggctaattgtttgtatttttagtagagatggggtttcactatgttggccagtctggactccaactcctgacctcgtgatccgcctgcctcagcctcccaaagtgctgggattacaggcatgagccaccatgcccagtggacagatgtcttttatttaaatgtttgctggcttgattttgtcaattttaaatattagacatatgacccataggtttccatttgtcgctttgccccaggcacttcaaatactagacatgggcttgtcctggtgtctggaatttgctgatactacctttaaggattacgataaaattcacaaactgtatgaaaagattctctttgcatgaggctgtccacatgggtatttatttgaagaccattgctgaaagaaaaaaaaaatcaaaatcttgctttcgagtcatactaatagttcctttcctactaaactaccgcctagttgacatctaagcccatcaggacgtaagaaaaagtggtgctaatatcagagctgtcagtcagttttgggaagagattaactccaccagcatcagctaagagtaggtagagagactttggaagcagacaggctgaagcagttagtgaatttgtagaaaggattctttcacaaatggaaggctgaaaaataatgggtgatgacatccatcttccaaggaaaagagtaggagactaagaaggttgtttaatgcttaaaaaattatccattagaaataaatcatgtggctgcatccagctgatgggagacttggggtacacatttttatgtaccaatctgtcaactctcttactgtgggaaaaggggagaatgagtattaggaagcaaagagctgtctccgtcccagagaaggtttatggaaatgcttaacacaatgctcagttcacagcaagtcaccaagaactattagtgtcatcataccaataatcaaaaagagaaaatggaaactttgttactttttgtgagacgatatccaaacctataaagaccccaattttcactgctatttttcagagttgagcaaaagcacagatatggaattagaagtcctgggttcaaatcccttaggcaaaatatttagtctctctgggtttcagtttcttcatctgtaagttggaaataatgatatctacttcgtggtggtggttgtgagtgttaatgagaaaggctgtaggttaaactctatagcagagtttctagcacaagagttgatactcaacaagtgttttttcatcagtccattcactcatgtattcattcaacaaatattaatcaatttcctactatgtgttaagcactctggtaggtgttaggaagaaagtgatgaatacaataggttatttctgacctcaaggagctgtggtatagtttagtggtacacagacattaaacacagttactaattataattattgttgtaataaatagtatgaaaacaatatgaagagactctcagtatagagatgaatcataggtcaggattagggtgcttatggagaaaaatcaccaggtaaatgaatttgagaaataattaaaatgtagaatcagtgagtgtagggatgatgtctaaacaatgggtagatagggatgtcatgtactgatgatggggaagacagaggcagggatgtagaaggaagtctgtggaaagaaggaaggaaggacggacggatggcagatagacaaaggaacaaatgaggactgctttattagacaaatagaaaaatagagaaatgggtgagactggatagatcaataataaatctttggtggagtatgtggggcatataggtataactcaataaaacaatactgcattatttatttttgtaggattcccttttttgaatagttagaagatttggataatgggcgtcactaaaacattgatttttgttgagagttaaaatgccataacatttttaatgttaaaagaacacaaacatatatacttgagaatgaaactggatcaaacaaaactgtattttctaaagtctttaaattacacactttctagcaatcatcattcttttatacattcaacatatttctgaagactaaattggagggttggaggataccaagataaaccatgtgtggttttgccttcaaagggtaggggagacaggattaacatatatgtgaagataacatgatgaaaatcatgaatttaagaaaaatatggataaaacactataaacatcctttaattcttttaaaattgatacataataatttacatatttatggggtacgtattggtgttgtgatacatgtaacgtataatgattagattaggatagtcagcatagccatcatttcagacctttttatgtgggatcctttttcttatttaatcctcaaagtaacccttagaaatatgtagcacaattattattattattattattattattgtttgagactgagtttcgctcttgttgctcagctggagtgcagtggcgtgatcttggctcaccgcaacttctgccttccgggttcaagcaattctcctgcctcagcctcccgggtagctgtgattacatgcatgtgccaccatgcctggctaattttgtatttttagtagagatggggtttctccatgttggtcagactggtctcgaactcctcacctcaggcaatccacctgcctcggcctcccaaagtgctgggattacaggcgtgagccacagcgcccggcctgtagcaaaattattaatatcattattttacagatgctaaaactgagatgcagagaggtcaagtgacgtgacagaactagaacttgagcctccaatcttatccaccatctcccctctaccacacaccacctataaagaatgagaaaatcggccaggcgcggtggctcacgcctgtaatcccagcactttgggagggcgaggtgggtggattgcctgaggtcaggagtttgataccagcctgaccgacatggtgaaacctcatctctactaaaaataaaaaaaatagccggatgtgatggcaggcacctgtaatcccagctactcgggaggctgaggcaggagaatcgcttgaacctgggaggcagaggttgtagtgagccgagactaggccattgcactctagcctaggcaacaagagtgaaactccgtctcaaaagaaaaaaaaaaaagactgagaaaatcagtagtgaaggtgggaggagacagtaggatggctgaggatgtgtctcaatatgcacctctggggtaaggcctttgggagaagggagaaaagagtaaaacagcctgcatccttactcagctgatttcttcccctttacaggtcgaagtatttccatgggaagaaggtgaatggagagattgagatccgagtggagcaggtaggtgggagctgtgtctttagcactgtcaactgaccttttctgccgctggggctgttcttacatgcaatcttggtccccatcttatgtggtcataatgagccaagattaccagaaaagtccaagcttatacttgggagtctcattaaatttcagaattgtttgggccagtggtttccaaccttttatgttttagcagagaccctttcttcaagggaaatgtcaaataggaactcattctacaaaagagagacacgtagagctgctctgatggaaatgggcaggtggagcccaacttctgtctgttctataccgttccttttggcccctggggcatctccttgcagccacctgggctagagagcatagtttaggaacataatgaagggccttgaatcctgcctctctcattttctaggttttgggtaggtgacttaatctctctctgccttgatttccttatatcattgtggggattaaattatttaaaacctcagaagggaccagaattgcaaatactatctcttgctattgctattaatatcaatatccaggtccctcattttatgtggaaagaaacacagatttttttagggctgtgtagggaggcagtggcagaatcaggagtggaaggtgtggtctcctggctccagatcaaagctttctcctgttcgttccgcgaggacctcctctctgccaaacactgtgctcagccttaggagagcacatttgagcataggttctggagccatactccaggtttgaatcctaacaccgccccttactaaccttgtgaccttggttgagcaatacttacactccctccagttcaatttcttcatctgtccaactggggcaataatagcatcagcctgtgttcatagggtgctgtgaggatcaaacgagttagtccatgaaaagtgcttgaacagtacctggcacatactgggcacttagtaaatgttacccatttatcatcagcatcattattctttatcctcttcctactcctcctcctcctcatcatcaaaggcaaacagtaaataacatagacaaggtccttgctgtaaaaatgatttcaaaatacaatttttaaaatggggggcatgactgttcttctccctgcactttttgagcttaccgtgtcagagaaacagaaaggtcttctaagcaaactaagttggcttaatattaaaacacctacactttgaatttcaatttgattctgtggctttcaagtcaacccaatgtctactggttttccttccatggcagagaacaggttatttttgttcattttgcaaatatttgtcaagagtctactatgctagctagctaatatgtggagaacgagtatatagaagaagaggcccagtctccaaatgcctgtggtctaggaggagaggtgagctaagtcttttcttttctttttctttctttcttttttttttttttttgagatggagtctcactctcttgcccaggctggagtgcaatggagtgaactgcaacctctgtctcccgagttcaagtgattcttctgcctcagcctcctgagtagctgggactacaggcatgtgccaccatgcccggctaatttttttattttttattttttttctatttttagtacagatggaatttcaccatgttggtcaggctagtctcaaactcttgacctcaaatgatctacctgccttggtctcctaaagttctgggattacaggcgtgagccaccacacctggcctacagaacaataacattgatgatggtagcacacttttattgaacatttactatttgctagatgccatattaagtgttttccatgcagtcactcattcaatccacacagtatgcctgttgctgaggaaacttgggctcagagagcttaataaattgcccaggcaggtcacacagctagtaagaatgcagtgaagctgggatttgaacttacaggtagaagccagggatgagaggtccaaacttagcactcctggcagcagaggtcacagtcaactgaaagactcaggtgtggcctcgaggagggagtggtgtttgaaatagatcaaagaatggataggatgtcaacaagtggagatggtggcgtgaagagcgtgtgaatggaggaggcagtgtgagcaaagataaggagaccagaagtacagggtatggagtgacagggaatgcggtgtggttctccaaaataggacacatcatcttcccctgcgcccaccctactcctccctaattctctctctcaatgaagagtgtggccatctaccttccaccttagccagaaacctgctctggctcccggatgtgcccctctccctgtaccactgcacccattcaatgactggaccctgctgactccgcatctgatatttcctggtccctccacttctcccttcatccccatcacctagatccttggctggaccaccctcaactctcgtccagtcttcctcatcaacagcctcacaacttcatgttttccacccatctccaatgtattcttcatcccaacgctagagtgatcttcctcaaaaagcaaattaggttctttgaagtgttagctttacaatcctttcctcaaagactccttctctgagtctttccagatttaaatcaggtaacctggttattccctttcatagctcctcaactttttcttcctggcccttatctgagtttctagccacacattttgagtgggacgatttgcatgagggtggagactatgactgtctggatcttaccctaagtagcactgggcctggcacaaaagagaactgaaggaaatatttgcaggatgaataactgatagattctacagattccaggctgcttgtcagtttccaggggcgataagtcaccgcttctttttttttttttttttggagacagtctcaccctgtcgccaggctggagtgcagtggcgcaatctcggctcactgcaacctctgcctcccgggttcaagcaattctcctgcctcagcctcccaagtagctgggactacaagcacctgccaccacacccagataatttttgtatttttagtagagatggggtttcaccatgttgtccaggatggtctcgatctcttgacctcgtgatccacccgcctcggcctcccaacgtgctgggattacaggccaccacacatggctaccacttcttaatctcccctcaaaaatctgggttttccataaaccatctggtagatacttggttgccagctgagctcaccctgcctcatcccatgtgtggaaatcccaggggcatgttttaattttccccttttatcttagcaatgccattggcccaacttgtcagtacaaaatctatgagcaggaccatcagggaattgccctaagaataactcacccaggggctctggggcccgtcagccagtctatgaagtctacaatcacactgagaaaccttggctaatttagagtcattctgatttccaacctgcccctctatgaaagccagaaggtgaattagccaggaaaccaattagcaggtcatttgggcatttttccccagtagacatacctttccaaatccatcttggaatcagaatcacttgtctttgcccatctgtatcaatgggtggaacacacaagcaaccccccccccaggaatctcacatgcatcctttagcacttgggaaaagtctcaggacggaagccactgtttagtctgagctggcctcacattttgggatcctgtctcccaaccaagggccaaattaaccagataattgcactgtctgggttttgctggacagagcgaatgagttagttgtggttggcctagaggaagcctccgccccttctctccatcctcttccccccagtctaaaaactgcttgcctcaacttttacagagccaggaatcaagaaaccctggggaggcccgtggaggagacagcacattttgcattctattacccagaatgccctactggctctgcggggccctcacagcagtatcctagtagggtctgagaggatcaggccaggatggttggcatgtcaaactctcctctgtttatatttgaggcaaagggtctttttctccacaggcacaagtcacccctctgtgggaccaagcagtgaggttgatgaatggattaatattaagtagactcacagttctgggacatcagtggactaggacttgctagggtagagcctcagtctctaatttttaaaagagaagactgaaatcaccacggccagtctttcctccgtgttgacagaggtaccaaggcagaaagaacactaatgccttgctctagcaggtggagcaaaaggcaagagaaggtataaaccctgcccttgagcaactcccaatccaatgaaggaagccagaacgacccatggatttacatatgaatactagttgctcctttgagtactgtccttgtgtaatattgggttgggatggggttaggaaactgtccaggggaggctgctgttgggagacctgttcatcttctgccctttatgtatttaacatcaatgtcttctgaatggaaagatgagatattccccttaaaatattttaaacacttcagaccccgtatttatattttctcacatgcacttcagccttcaacccacaattctttctgggacatttcttagaatggaccttagctgtagatattgaccataaagaccaggtgatatttcaagaaacagttgtcaacaagatagagaagtgtaagttggatgttaattcagtttggtggtttggtaacaggttgaacatcatcctcattaggaaatgattacttgatagaaataaatacaccttgggagaaatctaatggcttgccaaaaggcttgtccttggctttgttttccttcttactagtgacttatgaaattacatttgctaatgactttaaactagatgggagagagaatacgccagattaaatttgatgtgatcaaattgaataggaatacaatataaagtcgagtcggtggtggcaattcctgcagcctcagtgagagggagagtgcaggttcggctggttgcagtagctcacgcctgtaatcccagcactttgggaggcccaggcaggactgcttgagcccaggagttcatgaccagcctgggcaacattgtgagactctgtctctgcaaaaactaaaaaatgatgactgacgaccttaagctgatgggctgagttcaaaaactcagctgtgaaggagcaggattaaggagactttttttttttttttttgaggcggagtctcactctgtcgctgggctggagtgcaatggtgagatctccgctcactgccacctctgcctcctgggttcaagtgattctcgtgcctcagcctcctgagcagctgagattacaggcacctgccaccaggcccagctaatttttgtacttttagtaaagacagggtttcaccatgttggccaggatggtctcaatctcctgacctcatgatccacccgcctgagcctcccaaagtgatgggattacaggcatgagccaccgcacccagctggggagacctatcttgttaacatcacatgagaaaaacgaaaaagacctaacatttgagttgagcacagcttaatatgtgtgggaggaaatgcggtgtaggggttaagatcgtggctccagagtaagatagactgaagatgaaatctcagctcagtcatattttagctgtgtttgctttttacctaaaacatctctaaatcaatttcctcacctgaaaatgatgaaataaattttattccctagagttattgtgtgacaaaatgagttaatgtaatatgctgaacatttgtttccggcacatgtattaggtgctcaataaactacagttgagattgctactcccctaaaacctgatgtcacttcaggctgcactatcaaaccacagcagttagaatgcaggaaggtgatagttcatacactccctcttacatgcacacacacacacacacaatgctagtgagacactctaataagagatccagttgtgtgttgctctggaagggggttgcagcaacctggaatgccttctgaaaagggattggagtaagggaaactaaggccaataaggaaagaggattcgtttaaggaactggagatgtttagtccggaggaagaaaggtctctgataggtcccagtctactctttacaaatatctacctcttgaacaagtatggttgataaagtaagttaccatttgttgagtccttatgagataaagctgaatgcattttatgggtgaagtaggcactgttatcacctccatctttcagaaactgagactcacagagagtaagtgtcttgcccaaggttgcccaactaataagtggcatgggtctgtttttgaacctagccagtctgacttcagggtcctcttcttatccactgtatatttttttcttccagtgttgtaaatatcaagaacaataagcaaaagtattgattaaagcacttgacatgcataatcttatttcaacctcacaatgcctctttaagatgggtactttgagttgggtgcagtggctcatgcctgtaatcccagcactttgggaggctgaggcaggcaaatcacctgaggtcagaaattcaagaccagcctagccaacatggcgaaaccctgtttctactaaaaatacaaaaatcagccaggcgtggtgatgcatgcctgtaatcccagctatttgggaggctgaggcaggagaatcgcttgaacccaggaggcagaggttgcagtgggcgaagatcgtccagcctgggtgcgacaagagcaaaactctgtctgaaacaaacaaactaacaaaagatgggtactttgtcccttttagcagatgaagaagctggggctcagagatgttaaacaagcagcagaaatgggtgatagaggaggaatctgaacccaggtttctgtgctaagtatcaccctctattgtttcactggagttcgagttcagtctattggtgcaatcctacaggaagatggatttcaacttggtctacacagaaactgttaagtagtgctgaactaataaggaatgggccatgccttttttgtaggtagggcgcctcctgtgctggaaatgctgtggcagaaactgggtggctaccttggggaatatttcacaggaaattaatgtgcttataggagataacctttattaatctttttcttttttggcgggggtaaaagtagtatattcaaatagttaaaaattgaaaagctacacagtggtatgtggtgaaaagtctgcctcccactctgcccgcaccaatctagttctcttccatgtacttaactattatcactagtttcttgggcacctttccagagaagttttaaatgcaatgagcaaatacatatatatgcttttcacagagggtggttggttagaaaaacatcaaccatgctatgtatttcagagggaatttaacaaggaggattgattacaaatggatcaaaaggggaaatcattttacccagaggcacaacagtcctacattcactgtttgtcactgtcactattgtcactgaggaatgaggagcctgggctcttttttgttgttgctgttgttttgttttgtttagtttttgagacagggtccccctctttcacccaggctgtagtgcaatggtgtaatcatggttcactgtagcctcaaactcctgggctcaagtgatcctcccactccagcctcccaagtagcttggaccacaggtgtgcaccaccatccatgcccagctttttttttttcttctttgtttagtttttgtagtgataaggcatcgcgatgttgcctaggctggtcatgaactcctgggctcaagcaatcctcctgcctgggcctcccaaagtgctgggattacaggtgtgggctactgcacttagccagacctgtgcttccactgaggctacaggaattgccaccacttgttcaaactgctatagttgttggtgaagcttctgtaactaccactagaagcagaattgttgctgccttctttctaccttcaattcctgcatgaatgcctcccattggtagaaatgagctgaaattatgtggcaaaaggatctggggaatgcagattttaggctttcagctcccatagtgcaggagagactatagaaggatgagtggcaatagacagtgactggcacagtccacccctttggctacttggcatctacacatgcctttctccttatccatactccactgcaccctcatttttcacttaatatttcttggagtttattccatgagagtatatgcagacctgcctcattcttgttaaggatggcctggggtctgtcatatggatacaccataatttgttttccataattttactattatagacaatgctaaacttatgtcatttcaaacatttattaatcgatctgtaggattcacttctagaaataggataacttgttccaaaagcattgcaggtggtggatgctgtaatgcacattgaggaatgaaggacttttcttcattcctctgtcattcctccttgaaagtgcctcagatgaggagagctgcctcttccaaggtcacatctccttcctggtggcagttacatccaatgactggccgtcagaggctataataaatccctgtccccatcaccccagtttgggataactctgaagggctgtccggcttcagagcttcttgcagagttgccggagacctctgctgagacggctgtgtggcccaaattctcacagtcctgcttcctttcttttcttcccccttccagtgatggagctcccagggaattcactaataaacctccccccaggctaatatccatcccagggtctgctttccagagaacccaacctaagagaacacatttataattttgatagatattgcaaaattactttccatagaggtcacatagaattcatccgtaagactcttctggtctcgatttctaggactgtacgtgacccgtgagttctggagtccatcctgcacagaatgctttcctggttacagcccaggcatggatgctgaactctgaagtgctccataatttgatcttcctatttgacctccttgtgtttgaaattcaccagagcttggtgtttctctgcaggactgagtcggacagaactctacccgctctgatccactaagccttgttttgttaacacaatcctgcaagatttatttgtttggcttggcttaccctgacctcagatgttctgttttgtattatttttaaaagcgtgcaggtctccatggaggcctttttcttttcaaatctaagaaccagctggggggataaaaaaagcaggtggaatactagggcccattagctgaaacataactcattagagaagtgagtgtttcccttcctaaccatggcattgattaatgtaggtttatcagcttcctgggtctacctttaggctcatcaacttaagaactctacagaaaatggagaaacaataacattgatgatagaagcaaagtttattgaacatttactatttgctaggtgccgcattaagtgttttccatgcagtaactcattcaatccacacagtatgcctgttgctgaggaaactgggacccagagagcttaaataaattgcccaggcatgtgacacagctagtaagaatgcagtgaagatgggatttgaacccaggtctggctaactccaaggtcttagttcttaatcaaagtacatttatcagaatatatgctggtcatgaatttgtctttacaaagctttttgcctttccccttccagcttgagtacgtatcccacagtatcttcctatctcaccctactcttttgatctactgggtaaattacaaattcatatgaggtgttttcccagcaaaacagtcctcttttcctgactaaccccaatggttattattcatcatttcatgtttctggcttattcctgcatagtttctctgttaacaattctatattttttcattgttttcccccaagggctgatgttcattattgtctttaaacgtagctctccgtctttacctttttttttctttttttttttgagatggagtctcgctctgttgcccaggctggagtgcagtggcgtgatatctttttttttttttttccaaatagagacggggtcttgctatgttgcccaggctggtcttgaattcctgggctcaagtgatcctcccaccttggcctcacaaagtgtcgggattacaggtgtgagccaacacgcccagctaagctctatgtctttagactgtctggatagtataatagcttggactctcaagccagatcaactaggtttgaatcccggccccaccacttcctgagtaaccttgaggtggtaatttaactgccccatgcctcagtttcctcatataaaatagtaagtgcgcatatagttgtgagactgaaataagttactataagactgcatgaagcacttgaagcagagcctagcatatagaaagtgcttaataaatattagaactatttttatgatcagcttcacgtcactaaacacatttgtctgagtagtttctaggcttcagtctcttgaagcattcagaaatagaaaggatataatccatgcactgaagaagtttgcagtgcagtttgtgggataaaaaatataaaaagcttatgtttgtgtgtgtgttttgattatttacacatatgttcaatcatagttcccattgatatacaacattcagttggcacctgtcatccatttctaacgtctctttgatagtagatagcacagactctggacctgaagaaaaaatgcaatgaatgtttgttgagtgaatgcgtgagtgagttgaaggtgtgacatagtcatggaaggatagagccagggagtgtcctaggagattatctaatcctgctcccttgtttaacagctgaaaggttcagagaggggaagtgacttagcacacacgtgaaattattgttggagtccaaagtgtggagagcactagctttcatctcctgggtccctgcttttcacactgcatttctccccctgcccatgccatcttttgtttttcccttttaagaagccattagtcccttctgatggttttaatagcaagcaaaaaaatagcaaaaacaaatgaagtttatgtttttcacgtttacctgtgagaagccttcttcttgggaggagcctaggatagagtgctgaaccatagctgatagccaaaggagagctccaagcagcgagggctggggaatgctgaaaccaaggttgaatgagccccgctgattctgaacacaacatggactgtgttgcccgttgcatgaccctttagactctcctcttcttttctgctggaggagagtacagcatcctggtttggtggcaccattcagcacctgcactggagatgagaaggaaggaggcatgggagtcaaagggagtccatcctcttgcactgggaaacccagctcagttccttggcctttagctgctgtgtttggaaattcacctttccttactgccacaccacttcatcagcatcagcacggccccctgttagtaccattgataaatgagactccagtggaaattaagtggacattctgaaggagaacttagtaagccctttcacttcttgaaggatgtgtaacaaaacaaacagagcttgtcttatctgaacctgttccttcattcaagaagcactcaccgagcacctgctctgtactttgtcctaatgacagagccctccacactcaaagggttctttatctggtgggaagatagacattgaaggcagtggccaaaatgtgttgcgacgaggatctctctatcgtagagatttgtctaaccttgggatgttctcaggaaagacctcacagagaacctgatgtgcagctgggtttggggacaagaattaggtgagggtgagtgggcagatgtgcacattgggccttctagctaaagagcatgattcaagtctcagcttgtcacgtacagggcaaatgaccagggtatgccatgcatgagaagggttggtgggagacgaagctgacaaagaaggtggagggcagtctattcagggtgggctattagtgcaaggcatgcaactaagaattgtgtcctagaggcaggatgtatgtattgaactttttaagccatggagtgctgtgaccgtgatttcattttagaatgcacaggctgacagtggtcttagaagattcgctggataggaatggtggcttgagactggaggcagaaaagctcagctctggatttggtgcaaaagtcatctcatccttgaatatgatgcttgggtaggaggcacatggaagggacttcataagtgttaagtgaatgcatgtacatcctcgccactgtgttccttaaccacttgagccattctcatacctgtaattcgtatttgaaactggaggagaagagatgacctatttttcttaagactgagaggatggagtcagacccacatgatgtgtttcagctggcatttcttgaaagcgagccattgccaacctcctcttgttcaccaccttagtccagccacttggactaagccgtttcacactgcacatgtcaacttgctcccaatctgcctaatccccagccttgtgattccttcatctgttgatgatctccctccccatgcgctactgcccctggttacaccacttctccagcgtggccttcagcttttgtgtggctactctacattttctgccagctctgctgttgtctgtaccatttggggtctggcccactccctgatgagaggagcccccactgggctcaccccagccctgccagcagcctctgcccggatgtgcttacacagtggatttgagcctttgcatttcagtgggaatcaagggttattaattaacctagggtggaacctattatgaaacatcccagaaaactggaatgaaccaaagggacttctgaactcacagcagggaaaaatgccttttaattgacttggatgacttcactgcaaaaatctgtctggctgttatgctaaactggaaactaatctattagattgtctaaggaatctcccagcccactctaagcagagtctcctgaggaggggagtgagctgacatatcaacaggacttaggcattgaaatgacttcctttggatcatacacagtctgggcgcattttctagtccctcaggaaggagctgggaggctgatagcagagaacgagtttatgtgccctacaatgtctatctttagtatcacataggattttagtagttctaaggcactatttactttacaatagaattcaacctaaactggacccgttttggtccagtcttggccccctcatctcagggagttttagagggtgacctgagagagtttccactggcggtgcctgaggcagatggcagctgtacagcctgggctctgaaggaattaatgatcataggcagtatctaatcacatgcttactaagtgtcaggcacacgctaagcatttcatatggattagcgtgtttcatcctcatcatgactctgatgaacaggtactatgagttcccccattctccagatgaggaacctgaggcttacccaaggccacacagcatacaagtggcagaactggaattcagagtcagtttaactgaagaatctgtgtttatggttctttttattttattttattattttttgagacaggtttcactctgtcacacaggctggagtgcagtggtgtagtcatggctcactgcagcctcaacctcctgggctcaagccatcctctcacctcagcctcctgggtagccgcgatgacaggtgcgcaccacaacacctggctaatttttaaaatattttgtagagacagggtctcactgtattgcccagactggtctcaaactcctgtgctcaagtggtccccacagcttggcctcccaaagtgctgacattacaggtgtgagccaccatgccctgcctgtttatggttcttaatctttatgctggctcatctgggaaggtgtatcctgaagcagtaaaatccagggaaggcttggtcactttcctctcatgcataaagggctgacctgtgcattagacttgttttgggggtctcaagctctgcacacaaggccctccatgagcttgcccctgcctgcctttccttgctcatctcctcccgtgctctaccttagacttcggtctcaccaaactgctgtggttccccagtgcccacccatggtaataccatcttggagtcacatctccatgcctttgcttatgcacgtctctcctcctgggacatcctttcttagattttgccatagattcttcaacattagctccaacatgatgtctgtgctgcttcctctgccctccccctccatccaggcagggtgaggtgcctcttccctgtactcccctagcacctcatacctgtgtctacatcacacttcccagatgactttgagattactaattcacctgcccctcgctccctgtagactctgggctcattgggaacagggacagtatctttattcattccacaaatattcattgactgcctatgtgctgcgtgctcaggttacaatggtgattaaaaacagatggaatctggccgggcgcggtggcccgtgcctgtaatcccagcactttgggaggccaaggcgggcagatcacaaggtcaggagatcgagaccaccttggctaacacagcgaaaccccgtctctactaaaaatacaaaaaattagccgggtgtggtggcgggcgcctgtagtcccagctactcgggaggctgaggcaggagaatggcgcgaacccgggaggcggagcttgcagtgagccgagatcgtgccactcacttcagcctgggcgaaagagcgagactccatcataaaacaacaacaacaacaacaacgaaaaagccagatggaatctctacctgatggaacttaacatctaatggcaggggccagaaattaatcatattatctatctgtctctctctctcttacgcacacacacaagcatgcacacacacacacacacacacacacacacacacgtacgcaccataattacaaactgttagaagccgtgaaagtagggtacacagtgctatggtagactgtggtggggaggctggcaggacacttattcggtacataataggtgctccaaggacccagatacctaatctgtgttcaatatatatttctcaaacttatccagagtggggaaagatgaaagaagctaaagagaaaagctttaggctactgcaagaacccaaagagcctttggcatggtaaacaacacaaacaaagcattagccctgcaggaatcatgcagataaatcattgatatagtacagtgcaggtaaagcaagatttgacattaacatttacacaatgtgcaagccatcctctaagcagtttatctgtatacatttaattttcatcaccaccccacagagtactgatggaactgagactcagagaggttaagtgtcctgcccgaggcgacacagctaggagatggcagagctgagatgtggacccagatgctccagagcccataccactgacccctgcattgaccacctttctatctcatctgttgaatggggactgatcgaggtgcagtttcttgcttgggtcatgctgctggttactgtagagtcaaactaccatctgcctttgtctcctccttgccaagtctgactttagacatcctaaggggaagaacttggcaataataaaaggtcagcaccagacaggaaatggagctaagttctgtcatggggcatcaagggttgtacttgtggagttctgagtatatggtcaagaaggaaaataaactattagttcagtgatgtgcttttcattgccctcatgcgtttaacttttcaacatatttcgtccttcagcaactcctgaggtgtaaggctcattattattcagatgaggaaattgaggcttggcaaagttgaataggtcattgcttagttagtggcagaattgtgatcataacctgtgtctacctgttttcccctgactcacctgttgcccagccagacttgaaaaatgacctgcttcttacagcctaaagcaatttttcagatccatgttctcagggaccacagacagcctctctgggttttctgacctttctttttttttttttttttttattatactttaagttttagggtacatgtgcacaacgtgcaggttagttacatatgtatacatgtgccatgttggtgtgctgcacccattaactcgtcatttaacatgttaatgctatccctcccccctccccccaccccacaacaggccccggtgtgtgatgttcctcttcctgtgtccatgtgttctcattgttcaattcccacctatgagtgagaacatgcggtgtttggttttttgtccttgcgatagttcttaagccatgttgctggaaccttcctttcttccctaagcaacagccctgaggttcatgtcgtgagctaatgggtgagttcttggcctgtttaaaatggaactgaactggtgccctccccacccagcccacctcagggcctgccttctgtccagacagggaggagacgggaaggctcaccccctctagtgctgccaggaaaagcaagggaaagcagaggggcctgaacctccccttgctgggccagccaagtgccagaaaccccaaactttgcattcattggacagaaccagattttgattactcgtcttaatttgcttattcttgtacaattgctttggtctctcactggctcccttagctctccacggtgcaggctcctcaatgtctatgggatgaaggccaaagtctttaggcagcaccagggcccttcctaacctggcaccagcctcgttttctcaccacctctcttttcctctctctgcttagtggtccccatgagagacattggaggaggcaaataattaatttataaggtttcttgtttatggtggctttccctcaagttctgcatgttggtgtccaaaagtgttatttctatataatgaatatctatgcatctgaccatttgttcagtcatccatccatccatccatccatatacttatgctttctccatctctctagaacctaactctccaggcttctgttttgcggtctctaatcagttcagaactaggttttccttcccctaaacaccttcattaaatttagtattttgggccaggcacagtggctcatgcctataatcccagcactttgggaggctgaggtaggcagatcacatgaggccaggagtttgagaccagcctggtcaacatggtgaaaccctgtctctactgaaaaaaaaaaaaaaaaaaaaaaattagccaggcatggtggcacatgcctgtaatcctagctgctcggaggctgaggcacgagaatggcttgaacccgagaggcagagattgcagtgagccgagattgcatcactgctgtccagcctgggtgatggagtgagactgtgtctcaaaaaaaaaaaaaagtattttgtaatgtcaataatagagacaataataatatcttaagccatttatccctctctctatataaatgtatatatacatatacatacatatacaaatctatatatatacatttatacccatatagagagaaattgtttaagagtcattattatctatattgatagataaatatttatatatatatagagagagataggtagataagtaggtaggtaagacagacagatagatagatagatagatagatagatagatagatagatagatagatagatgccgatactctgccaagactttactatctataacccaattttctgcttacagtgatcttgtgagttacctgttactattacagacaaagaaactaaggttcagagaggcccagcaacgcagcttagaattggcagagccaggatttgaactcctgtctgtctggcttccgtctggctcccaagctgcccatgctctataaaacactgtgtcctcctcactcccacagctaactcgccgcctcattcctgagatatcatctgctctccccatcatactgcttccgcgtggctttgggtttcttttcagtcttaccttaactgttctctgcatgtatttaatgggaaattacattaagattctaaaagtaggctgggcgtagtggctcacgcctgtaatcccagcactctgggaggccgaggtgggcagatcacaaggtcaagagatcgagaccatcctggccaacatagtgaaaccccgtctctattaaaaatacaaaaattagccgggtgaggtggcaggcgcctgtagacccagctactcaggaggctgaggcaggagaattgcttgaacccaggaggtaaaggttgcagtgagccaagatcacgccactgcactccagcctggcgacagaacgagactctgtctcaaaaaaaaaaaaaaaaaaaaaaaaagagattctaaaagtaaacaggctccttctcactgactcctctatagtattttatttgtgtggaggaacatttttttgctgcctcagtaggaagaagccatattttgagacactttggtttgatggacagagctgtacccgggatcagatggacaagggcttgaatcgtggctttgcctcctgttacctgggggacttcaagggagtggttcaaggttccaagctaatgtttctctattcacagaatggagctagtaaccgcaatgctactatgtccagcacacgttgagaatttggtctgttttagttaacactaagggaactttggatgtaagttgactcatttgtaaaaggaggaactgggaaatatacagagcatgtgcaacccccggccctccgctgttcaatgaaggcaatgccttccagcccagctgaggggcggcctcattatctttctctgcacagcagccagagctggcagcaagaccaaacccactggatgacctgaaaagaacttgcagttctcacattctgtggggttgctacgaggctacttaaacaggatggtaaattatggataaagtggttggatcatgagatgagctcagttggtaaatatatgatgggggtgaaaccaaaacccactgacaacacaactctactttttctagcctagagtgtctactgaaacaagtattttccaaccatgctccttagagccctactttaccacagaggtacctgggtactctgtgaactgttgggcatccttggaagagtagagagaaagagagagagagagagagagagatgctagaaagaggaagatacgcttagcctaacctgtctcctcttctgtattagtagctaacaaccaggggtgatttttgccccaatccccccaacaggagacatttggcaatgcctggagacatttttggttgtcacaacaggggagatctcctgacacctgtgggcagaggccaggtatgttgctaaacctcctacaatacacaaaacagtcttccgcaacaaagagttacatagctcaaaatgtcaatagcgccaaggttgagaaacccccttctagaccgaacaactcaaaaacacacctttgtgcaaggagccccttgggtaccctaaagacagtttatggtggtgtgggcttcactctggagaaacttcaccttcactctctcctgcagttcctgttagcagcctcaggatagggacagggtcaggaccttatgccctatttttacaggtagagccactgaggcaaaagggcctgtgatttccccaagatcccagagctaggaagttctagaaatgcaattgaaacccaggtccgtctgaccccacgctcagcactgtttgtgacatgatccacactggtcagtgtgtcccaggctttgtacccggcaacccagcagaggcctgacacctgtcgaaagtcctgaggggcatgggggaagctggtcagagcctgttgtcttaaacataaccaggatttgttttagttgagcatgcaagacgcgcagtcacatgcatgactgtcaagaaggaaggagctcttacactcacagtcccctagaaggaggaggcacagcaccccatgccacatgcaggcggggggcacaggggagcaccatgattgttcgtagacagagggaatgatagggagatgtgggcgagagcttttattgtgaatttgtggggaggagtgagcaaggcaggggaaacaggtttaggattggtgagtttgaattatttcaaccggccttggagagtaggggctgtccctagttgcctggtgcctatccctggggtgatcagggcagatgggcagtgccctgcagtgtgacagccccatatatagaggaggttgagcctgcgttggttggtttgcattcagagggcgtgctccaggcaagctctttggtatctccaagtcttggctaacctaggaagggcattccctccagggccagcaaggcccaggggtcaaagcatcagaatacagacaatgaaagacatagttatgatacctgtctaactccaaagcctcagcacactgttgctttctaacggtttttcaaaatagaacagttttgtttccaattaaattttatgtaaaacccaatatttaagcagattaaaaaattaaaattactgctctgtttgatgcgtagctggaaggtcctgaaccctttgagcctcaaaaaaaagtatctgaagttgggcatggtggctcacgcctgtaatcccagcactttggaaggccaaggcaaaaggatcacttgagcccaggagtctgagaccagcttgggcaacaacatagtgagatctttacaaaaaaattttaaaaattagccaggcattgtggcacacgcctgtagtcccagctgctggggaggctgaggtgggaggattgcttgagcgcagtaggtcgaggcagcagtgagccgtgatcgcatcattgcactccagcctgagcaaccgagtctcaaggagaaaaaaaaaaagtgtctgaggcctctccttaggctgcctcttgaaaagtaattcttttttttttctgagacagtgtctcactctgtcacccaggctggagtacagtggcgcaatcttggctcactgcaacctctgcctcctgggttcaagtgattctcctgcctcagcctcccaagtagctgagattacaggcgtgcaccaccacacctgtattagtccgttttcacactgctgataaagacatacccgagactgggcaatttacagaacaaagaagtttaattggacttacagttccatgtagctggggaagcctcacaatcatgatggaaggcaaggaggagcaagtcccatctcacatggatgacagcaagcaaagacagaatgcagaagatgcaaaagcggaaacccctgataaaacaatcagatctcgtgaaacttatcaactaccatgagaatagtatgggggaactaaccccatgattcaattatctcccactgggacttgtgggagtacaattctagatgagatttgggtgggaacacagccaacccatatcaacaccctactattttttgtatttttagtagagatggggtttcaccatgttggccaggctggtcttgaactcttgacctcaagtcatccacccgcctcagcctctcaaagtgctgggattataggggtgagccactgtgcccctccgagaagtaattccctcactggggttctatcgtcctgctgctcccattgtctcggactttgccgcatgttggaaggagcctagtgaaacagtcaaaagcagggaccttggattcagactcgtgtttgcatacttggtctgtcacctccctgctatgtgatctcataaaacatactaatctcatcatgcctcggtgcccctttctaaagtggggataataaggcctgtctcaccaggttactgtcaggattcattactacatgcaaagcccttagactagtgcctggcacatagtaagtgctaaaacaaaaacaaaaaacaaaactatgatagattttaaatctaatacaaatatagtatgtaataattattatattgtcactggaactatggatagtattcatacagctaccacatctagtgctattactactagtatcaccatttttgtttctacctctccaaagactccaactactacttctcctactaatgtactggctgggataattattgtcatcaccacccttgggtattgctaccactcaagtgtgaagatgcagaaagcgacgtgagcaatcactgggaggccattccggacacacttatcctgttttgcttgtatcctgtttgcacttcccttgctctgggtctagggggagtcgtttatgaagtccctgagatgtgtggagctgctgttgatgtggttgtggaagtgatgctacgtttacgggatgttttctctgagcctacagggttggaaatgatccattacagctatttgtggacactggacatgtgaatgtcattgtgagttgagcatgttgttgtctcagaagtgcagagggcctctgtgctcctcagaatatggacagacagacctcattgcctttgcttcttgatgcggaatgcatttgccacaggtgggttcttttccctgacactgtcccttgcagtccccgttttggagattaggtttgggttagcgcgaagctctatctgagtcatgctggggtggaaccacggtagcccctgtggaagaaaatgagcatctgagaagaggaattcagcctttagaaacatgagtctctattgagggaaaagggatcagggaaacaacctatttgcaaggagcaaagtggcccttgggctccctcctttcctgagcctaggcttaacttggagatatttcacagcagacttttgaaagggtgaccagttcataccaagctgccttaaatgcttggagcaaaagcctatggggatttgcaaatcaacctcgggaagagaaattagctgtgtcttgctccaaagcttgctccaaaataaacacataagctgtgccggtggggagagcgcggggcttttttcttcttcattttaaaaactccatgtgtgcattattttaaataggcgccagcacatgaggcccttttaacaagattgaaaacagatggggccttaggctgttcggtagctttcagaaactcacaggagaagtgctaagccatcctgcatcccggcgatgttcattttcttgtggaagcacaagtccggccaggcctctcattcccagagagcacgagtctgcttcctgcatcaggtgtgtcagccaggggaaggaaatatctcctttcactgcatttacccatgtttgcgtttacttaacccttgggcagcttgggagaaaagaggattgtgctaatcttggagccctcgtgcttctggagttaaaagcactgggcttaacttccttattgtaaatcagattatgcccctctgtgggtagaaaaccatctctccagaggtgccagtctcactccaagccatagccaaagtccttcccaatacctaagggcccttcctgattagcctgccctgaccttgttcctgaccctattttcctggcttactctgatccatccacacgggctgtcttgctcttccttaaaatcaaacaacagaaaataacaagtgttggtgagaaggtggagagattggaacctttgtgcactgatgtgggaatgtagaatgaggcagccactgtggagaacagtatggcagttccttcaaaaattaaatgtagaattactgtacaatccagcaattctacttctgggaatttacccagaagaattgaaagcagggacttgaacagatatttgtacacccatgttcacagcagcatggttcgcaatagccaaaaggtggaaacaacccagatgtccatcagcagatgaatgggtgaacaaaatgtgctatgtccaaacaatagaatattattcagcctcaaaaaaggaattctggcatatgctacaatatagatgagccttgaaaacatgatattacgtgatagaagtcagacacaaaaggacaaatgttatatgattccagtaatctgaagtacctagagtagtcaaatctattgagacacagtaggatagaaattagtaggggtggccgggtaaggtggctcacacctgtaatcccagcactttgggaggctgaggcaggtggattatttgaggtcagagtttgagaccagcctgaccaacatggtgaaacactgtctctactaaaaatacaaaaattagctgggcgtggtggtgggcacctgtaatcctagctacttgggaggctgaggcaggagaatcacttgaacccaggaggtggaggttgcagtgagccaagatcgtgcctctgcattctggcctgggcgacagaacaagactctgtctcaaaaaaaaaaaaaaagttagtaggggctgggagggggacaggttctgtataacattttttggggggggcggtattagggttctctacagggacagaactaataggagattttatatatatatatatatatatgtgaatttattaagtagtattaactcacacaatcacaagttcacacaataggccatctgcaatctgaagagcaagtaagccagtctgagtcccaaagctgaagaactcggagtccaatgttagagggcaggaagcatccaccatggagaaaaagatgtaggctgagaggctaggccagtctagccttttcatgttcttctgcctgctttatattcactggcagctgattagatggtgcccacccagattaagggtgagtctgccttccccagcccagtgactcaaatgttaatctcctttggaaacaccctcacagacacacccaggatcaataatttgcattcttcaatcccatcaagttgacactcagtattaaccatcacaagtggtaatgaaaaagttctggagatggttagcggtggtggttgcacaacaccatgaatgtacttaatgccactaaaatgtacacttaaaaaaggattaaaatgataaattttatgttgtatataatttaccacaatgaaaaacataaaaatctttaaaatatcaagcaagtgcatcaaggcctttgcctgggcccctcatcccccaggtgtccgcatggctcatgccctcactgtattcaggtgctttgcccaaatgtcacctcctcagaaatgcttgccccccaccccctatctgaaatggcacttccatgcacacttctccatcactttatctgcctcatttttctttgcagcatttagcatcctgagtgctgaacccgctggcctttcaaagtgtctggtgcttagctggagctgtgataggaacagcagggtctatgcatttggggttcaaaggtggccgtattcttggaggtcccagtagtaggaagtagtaggtcctcacctgggggtgcagggctgttccctggatgtgcagactggatcatatggagggtaaatgagatacagggagacagtagttctagaacaagaaggcgaggtctgcactatgggtagcaatgagaatagaaaaggaagtctgagtgccttttttccttcctacaatcctgagaaagattttggacctttaaaatgaaaagaaaaaaaaaaaagaaaaggaaaaagcatttgaatttcttagagctttgatgaacaagatgttcctctcatcacattataactttgagttttccatttggaaaaaaaaaaaaacatttacagaaatataactgtaccagccccgcttcagctccttcaatatgtcccctcactatggtctgcagaattagaatccacagtgcccagctccagcagcatcttcttaccccaaacagcctctcttcccaggactgctttcctcttgcagtttctggttcatctgtggtactactgagtgttagcccccaacaatggactgtgcttccacatcttgatcttaatgcacccagaacccatccatcaggagagccagagggctgcgaggacactttttcacacactttgcagagcatttggcagaatggtgtctaagcatgtggagcccagctcatagcaatgggacgtaaatgtcaaggaaacattaaccactgttcttttctttgtatctaagctgtggtcttaaaatctctgaacatttgccctatccactgcaggtagcaaaaattcattgcagttagcaaaatttgtttctaggtctgtcgaccttctaaaagctctggaggtggggagagatgaagctgtggtggtctcaccatcctgttccccttaaaggcccctttttctccccttcgatgaacctccttcctgtcctagggacattattaaaggctctccccaaccttgaagtctcccctggcatagggcaaagggcaatggatgttttactttgattctcaggtgcggtttttgttttgttttgttttgttttgttttgttttgttttgttttgttttgttgggtgtgggtacaactctctcaggaaccctgagcaggaaggggcgactatcaggacagaattagggcatgcctggtcctctggcctccagtcaccagaaccccacctcgatcctagcaaatgtacatctaggcttttgggaacaaaactttgccattaagaaattccttaaaaatcagaacaatacatctaactgatgatttttctcaaacttgactccctaacatcttatattgccaagtgtgatgatgttgatgaagaaggaggagggggatgaggaggagaatcatctccaccattatcttccttgacaatagtggagatgatgatgttggtgataaggatagtaaagatgccaacatcttcccatctcatgcagaataaaatcctaaacccttgctgtgacctggtccgtcatcccctctctgatctcatcttctttcctgaccaccttactagccctgttccaggcacgccaattttcttgctgttccttgaattctgtatatatactccagcctcagggtctttgcacctgctggtctctctgcctggaaagccccctcccccgccccttattaataggttttgctacctcactttgctcatatcactgatcaaatttattcttctcctgacccctttatttaacacaaaactcaacttctggcactctgtcttcttgccagtgtttctctttcctctcccaatgtattatttatatttattattaatggtctgcactagaatataaggtgaggacagggaattttttctgttactttcactgctgtgtcaccagcccctagccctggcagagcagctgctcaataagaatgtcctaaatgaataaatgaataaatggatgcaaacagaatcagactgacctgagttcaagtccttgctctctggtgcaatagctttgtgatcttagccaagtcatttgaacactctctgctctccagttttcttatcaactatgaggaggctaatacccatgcttctatcaatgttgttgtgataatcaaattaattagtataaccttgatagctaacattcattacacatttatttttgcctaagcaccttgctaagagctttcaagtggattaattcatttaatgctcacaactgccctatgaaggcaccatagcctctttttacagatgagagactaaggcataagaaggctaacttgcccaaagttgtacagcaaggcaggggtggagatcagattcaaactcgtttgttctgattccagaaaacattatgttacatcaaacattttgtaaactgcaaaacactgctttttatttttaaattctatttatttatttatttatttgagatagggttttgctctgttccttgggctgcagggcgatggtgcaatcatagctcactgcagccttgaactcgtgggctcgagtgagccttccgcttcgagtcctaagtaactaggacgataggcatgcaccaccacacctggctgatttttaaattttttgtagagacagggtctcactatgttttcccaggctggtctcgaactcctgggctcaagcaatcctcctgcctcagcctcccaaagtgctgaagttacacgtgtgagccactgagaccagtctgatttttcaaatacaatgtggcaaacccatcctaattttgaatattctaatacatgaacatttaggaatgtaggtttttattattttattttttttctgtgtttttgtatttatttggacatttttaatgtgtttatccctccccaccctgcctgtccacacacacacacacccccccacacacacattattcacatgcgtgtgcgcacacacacactcattcaatattcacacacacacaggcatgctatgatttttctggtgggccaggccttcactgagatgccgagtgcttctactgagcaagatttcctcatctggaatgggctgctaggtgagtgggcagactctcaaagcctttttcgtctgcaaggtgagtctgaactggtgggaaagagctcagccctgagatgccagccaaggaagtcactgatcccccccaggaccagcaagctaaaaatacagcctgtgccgggaagtggacaggaagcagttcttgctgactgcaggcctcaggccacctgccaagtgtctgccatcggtggagcagtcagaagaggccgaatggaggaggggagggggcccatgggcttcgctgacagatgctgcaaactggtgtgcacaagaccgggaaggtgaaagacaagggcgactgtaggccacaaactgagtccgagctggcccaactctgcacactccaacgggagtcacctcaaataactggcatgcacttgatgtcacctcctgcccaccagaaaatcacacttgtgaagcatgttggcctgggtatgggtcccagctgacataatttccagggtggaacttggggaacagtctctgtgcttccttaagtcttatctttgacatctgcaaaatgggcattggttcattgagtgatattgacggagcacaggcactgttttaggagctgagatagagtggtgaacaaagcagataaaatctctgccctgcagagcttctacttgagtgagagaggtagaccattgaatagttaattgagatggacgtaaatctttatgtcacgtagggatgagtgctttagggaagaataagcaaggaaattggctgtggaacccagcagggtgctttgcagggaggatgcagctgggggcgccactgagagggactctgaatggcctgaggaaggcagccatgctgctggctcagggaagccctttggtggtggggacaggaggctggagcttgcttggtgtgtttgacagtgtggcaatggctgagcaagtcggaactagggggatggggggaggcatcagagtaaatcatgtgagaccttgtaagtcatgtagggtttgtgtttcctttttattatcactgctattgtttatcctttttgaatgagtgtctttggctatgaaagaatttaggaagtgaggaagatcataatacatgcagactgctgatgttttttaaaggaatttaatgatacagtttcattcccaagagtaaacatatcagtctgctaggaattagggtagaattttgatgataatttgcaagagggctcaggaatgccctaatccttccttgacaatcaccagcaccacccctgctacacccctcattataggttcctaagatggctgacaaccaaaggaggaacggcaaatcaccactgaaattacagtccagcgttagctgccccaggttcgctacccttagttcctctgctaaatctgggctgaatccctcagtttaggctttagaactaagcagtgcaacctcttaccctcccttgaagccaaacctcatctgcggatgttactaactagatatgtggctgttcttactcaaaagtcacaaggcctcacaatgacaactatgaaaaaatagcaggacatccgggcctcctgggaatcagaagaagctcccgggaattagagtttatggctgccaactcatagattggaagtcagagttgcagagagaaagatgaatgcttaaagatagtatctttcaggacttaaaaagcaggaaagaggaagttaacacaatgaccacccagatcaacagacacgtagctacagagaggcagaatgtggaggccagaatcacccccggccatgaccctgcccactagcaaatgtggcattgtgattcctgaccagtagactaactgcttctctttatgagatgcagtaagaaaaaccttatggaacagaccacggggtctgaagttgttctagcattaggagaggtgctgagagtgctgactttttcctgtgaacttagtacctgtgtgtctctgtctcctctctgtctctttttctctctctgtttctcctgcaaaatatgcaagtgcccaaggccatgggcaggggaacacgcctaagggttgggtttaagggtacagtctggaccagatacttcttcaccaactgacaggaattcccagtatcttatcagtcaccctgggattccagacaaatctatctgccagcatcttgcctttctcaggaactctggacaacatctcgttgtgtcacaatcctccctcagtcaggcttcaaggtcaaagctgacagctgctaccttcacattcccacacattcttggtttcttgtgtacattccagtcagtcatccacgtccatgtctcgatttctgcttctttcctattgacctgttggcctaataacatgcttcagcttagtattatgatgatgattacaatcaccattttccattctgtcatcaacatgattatcatcgcaaatgcaattattagtaactagacatgaataccccgtgctttcagtaatattatctgcttggcattaccttcttgtcaggtgccagtgccggtgaaaatgcagccaaagaccctacaggaaattgaatgcattccatctctattcctgtgtgcgtgcacgcatgcatgcgtgtgtgtgggtgtgtgggcgtgttcctgaaactggacacgagtttaattacaaacaggtgcttacaggttaagcatcccaagtccgaaaatccaaaatccagaatactccaaaacccaaaactttttttttttttgacatagagtctcgctctgtctcccaggccggagtgcagtggtgcagttatagctcactgcagccttgaactcaaagctcaagcatcctcctgcctgagcacccccgccccccgctggtaactgggtctacaggtgcacaccaccatgcctggctaattttttaaaaagatataagggtcttaccttgttacacaggctcgtcttaaactcctggcttcaagtgattctcccaccttggcctcccaagatactgggattaaatcagtgtgagctgctgtgcccggccaaaatccaaaatttttagtgatatgatgctcaaaggaaatgctcactggagcatttcagattttggattttgggattagagatgctcaactggtaagtatatatactgcaaatatttcaaaatctgaaaacaaatccaaaatgcaaaacacttctggtcccaagcatttcagataaggaatgttcaacctgtatctccttctgacctaggagaatgtcagagagattttctttctttcttttttttttttttagacatttaatgaaaaacatttaatgaaaaaatgtttccaaacttaatggaaattttaaacccaagaagctcaacgaacatgaaataagaagaaaaaacacaaaaccataccgaggaacttatttatttatttatttattgagacggagtctcactctgtcacccaggctggagtgcagtgacgcgatctcggctcactgcaagctccgcctcgcaggttcacgccattctcctgcctcagcctcccgagtagctgagactacaggcacccgccaccacgcccggctaatttttttgtatttttagtagagacgaggtttcaccatgttagccagtatggtctcgatctcctgaccttgtgatctgcccgcctcggcctcccaaagtgctgtgattacaggcatgagccaccgcgcctggcccaaagagattttcttaatggatgattccaattatatctagcacctataacagagcctggaacttcgaatgtgctgcataaatatttgtcgttaggaattgagttactcccctcctctgcaacccttagtgtttcctagtagcccgctacagtgtctatgccctagtccctggaacctatgaaaatgttattcaaaaggaacttagcagatgtgattacagttatggaccttaagacaggagaggattctacagtatccaactagaccccatcaaaccacacaagtccttaaaagcagagaactttctcatactggagatggagatgtggcagacaagaagtcaataaaaatttgaaaagtgaaaagtactcagtgtgccattactagtttgaagatgggagtacaacgtcataaggaaaacatacagccctaagcagctgagagtctctcccaggaaacgaggacctcagttctataattgcagataactgacttctgccagtaacctggaggaatctggaagtggcttcctcccagagccttgcaataagagcccagctggccaacaccttgatttgggccatgtgcaacacagaacagagaaaccaaccaagctaacctggacttctgacctatatagcagtgagataataagtttgtgttgtttgaaggcattaaatttgtgataacttttatggcagcaatagaagactaatatgctgtagaatgatattcacgttccttcacagggcactcaaaatcttcatgaactggtctcccagcaacctttgccttctattatgtgcttccatatactccatgtcccagctacaaacgacacctcaccattccattggccccatagccctattctcacctgtgcttttgttcctggaaacttaggttgagcctttcccctgctctctgcctgaaaacatcctccttgtcacagtctggaggccctggcaatgcagtttcagaaggcaagttgcttaatgtgtgagggtatccattcatctgtaaaatataaaaaattttggtgataagtatttttgaatacctactgtgtgccaggagctgggtataaaacaatgaacagctttcttataaaaaatattcctacttggctggcatttctttcttataaagtatgccatgataatagatgatttctttgatgacagttaggggacattggttgagaaaaagatgaacatataacagttaaatagaccatggacataattgattcaattaattatagctctttaattgaaagatgaagagagttaagagcagagaggaagtgaggggtttgcttaaggccatacactgggtcagtgtcaaattcaagatttagatctctgatctccagacttcaaggccaatcccttttccaccatttattcgttcctccaagtacatatttaaagagttatacacaaacagaaaagctcagatagtccagtacgttcagttatcattgagatcagtgttgaaaacctctcacagctagtttagcaagagtagcaaaataccaagagctctgtctgtgcctatatatagccctcatctagagaccaaagaattaaaacctatttgtccttaatgatgtctagacataatctcctacaaatgtataacatggctattttcccccctaaaacaatcagaattacatgcagccatcttcatttactaaagcaatatattatggcatggggtctttttttctgttaaaaataagggaaaaaagttttttttattatactttaagttctagggtacatgtgcaaaacgtgcaggtttgttacctatgtatacatgtgccatgttggtgtgctgcacccattaattcatcatttacattaggtatatctcttaatgctatccctccccctcccccggccccacaacaggcccctatgtgtgatgttccccttcctgtgtccaagtgttctcattgttcaattcccacctatgagtgagaacatgcggtgtttggttttctgtccttgtgatagtttgctgagaatgatggtttccagcttcatcgatgtccctacaaaggacacgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaacggtatttctaattctagatccttgaggaatcgccacactgtcttccacaatggttgaactagtttacagtcccaccaacaatgtaaaagtgttcctatttctccacatcctctccagcacctgttgtttcctgactttttaatgatcgccattctaactggtatgagatggtatctcattgtggttttgatttgcatttctctgacgtccagtgatggtgagcattttttcatgtgtctgttggctgcataaatgtcttcttttgagaagtgtttgttcatatccttcgcccactttttgatcgccttgtttggttttttcttgtaaatttgtttgagtactttgtagattctggatattagccctttgtcagataagtagattgcaaaaattttctcccattctgtaggttgcctattcactctagtggtagtttcttttgctgtgcagaagctctttagtttaattagatcccatttgtcaatgttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtatgaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttaaagtcaggtagcgtgatgcctccagttttgttctttcgcttaggattgtcttggcagtgtgggctcttttttggttccatatgaactttaaagtagttatttccagttctgtgaagaaagtcattggtagcttaatggggatggcattgaatccataaattgccttgggcagtatggccattttcacaatattgattcttcctatccatgagcatggaatgttcttccatttgtttgtgtcctcctttatttcgttgagcagtggtttgtagttctccttgaagagatccttcacatcccttgtaagttggattcctaggtattttattctctttgaagcaattgtgaatgggagtttactcatgatttggccctctgtttgtctgttattggtgtataagaatgcttgtgatttttgcatattgattttgtatcctgagactgctgaattgcttatcagcttaaggagattttgggctgagacgatggggttttctaaatatacaatcatgtcatctgcaaacagggacaatttgacttcctcttttcctaattgaatgccctttatttctttctcctgcctgattgccctggccagaacttccaacactgtgttgaataggagtggtgagagagggcatccctggcttatgccagttttcaaggggaatgcttccagtttttgtccattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggattacgtttattgatttgcatatgttgaaccagccttgcaaccagggatgaagcccacttgatcatgtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataagtgtgatgtgatgctgagaagactgtatattctgttgatttggggtggagtgttctgtagatgtctattacgtccacttggtgcagagctgagttcaattcctggatatccttgttaactttgtctcgttgatctgtctgatgttgacagtggggtgttaaagtcttccattattattgtgtgggagtctaagtctctttgttaagtctctaaggacttgctgtatgaatctgggtgctcctgtgttgggcgcatatatatttaggatagttagctcttcttgttgaattgatccctttaccattatgtaatggtcttctttgtctcttttgatctttgccggtttaaagtctgttttatcagagactaggattgcaacccctgcctttttttgttttccatttgcttggtaggtcgtcctccatccctttattttgagtctatgtgtgtctctgcacgtgagatgggtctactgaatacagcacactgatgggtcttgactctttatccaatttgccagtctgtgtcttttaattggagcatttagtccatttacatttaaggttaatattgttatgtgtgaatttgatcctgtcattatgatgttagctggttattttgctcgttagttgatccagtttcttcctagcatcgatggtctttacattttggcatgttttttcatgccagatgtaccggttgttcctttccatgtttagtgcttccttcaggagctcttgtagggcaggcctgatggtgacaaaatctctcagcatttgcttgtctgtaaagtattttatttctccttcacttatgaagcttagtttggctggatatgaaaatctgggttgaaaattcttttctttaagaatgttgaatattggccctcactctcttctggcttgtagagtttctgccaagagatccactgttagtctgatgggcttccctttgtgggtaacccgacctttctctctggctgcccttgacattttttccttcatttcaactttggtgaatctgacaattatgtgtcttggagttgctcttctcgaggagtatctttgtggtgttctctgtatttcctgaatttgaatgttggcctgccttgctaggtttgggaagttctcctggataatatcctgcagagtgttttccaccttggttccattctctcagtcactttcaggtacaccagtcagacgtagatttggttttttcacatagtcccatatttcttggaggctttgttcgtttctttttactctttttttctctaaacttctcttctcacttcatttcattcatttgatctttaatcaatgataccctttcttccagttgatcaaattggttactgaagctagtgcattcgtcacgtagttctcgtgccatggttttcagctccatcaggtcatttaaggacttctctacactggttattctagttagccatttgtctaatcttttttcaaggttttagcttctttgcgatgggtttgaacttcctcctttagctcagagaagtttgatcgtctgaagccttcttcactcaactcgtcaaagtcattctccatccagctttgttccattgctggtgagaagctgcgttcctttggaggagaagaggcgctctgatttctagaattttcagcttttctgctctgttttttccccatctttgtggttttatctacctttggtctttgatgatggtgacgtacaaatggggttgtgttgtggatgtcctttctgtttgttagttttccttctaacagtcagaaccctcagctgcaggtctgttggagtttgctggaggtccactccagaccttgtttgcctgggtatcagcagcagaggctgcagaacagcgaatattgctgaacagcaaaggttgctgcctgattgttcctctggaagctttgtctcagaggggtacctggccgtgtgaggtgtcagtctgcccctacttgggggtgcctcccagttaggctactcgggggtcagggacccacttgaggaggcagtctgtctgttctcagatctcaaactccatgctgggagaaccactactctcttcaaagctgtcagacagggacatttaagactgcagaggtttctgctgccttttgttcggctatgccctgcccccagaggtggagtctacagaggtaggcaggcctccttgagctgcggtgggcttcccagtttgagcttcctggctgctttgtttacctactcaagccttagcaatggcggatgcccctcccccagcctcactgctgccttgcagttagatctcagactgccgagctggcaatgagcgaggctccgtgggcgtgggatcctctgagccaggcgcaggatataatctcctggtgtactgtttgctaagaccctcggaaaagcacagtattagggtgggagttacccaattttccaggtggtgtctgtcatggcttcccttggctaggaaagggaattcccttaccccttgcgcttcccgggtgaggcgatgcctcgccctgctttggctctcgctcggtgggctgcaccgactgtcctgcccccactgtccgacacaccccagtgagatgaacctggtacctcagttggaaatgcagaaatcacccatcttctgcgttgttcatgctgggagctgtagactggagctgttcctattcagccatcttggaaccggcccgggaaagaaatttttaaaaatgcactggctagcaacaaatgcgcaaaaaataatacaaatgagagagtgggctcaagctttcaacaaggtggaaaagaagttaaaatgttaaagaatgtttagaaatatgctgaagtgtgaaagttcgttataaagcaaagagaaacctttagaggtgtgtgagcatgtcaatagtgagttgccataagtgccggtcctcagtataggtgatgatctaaaagaatagatgtgctttctcctccatttattaccctctcaaccagctgaccatactaacaagctgttaagaattgtggatttttttgtttttaattaataaaactttttttttaacctttaagataagtgagggtttcgttgaggaggtctttgagaggtctggctgcaatggtgggttggttgcaaagcaaggaatagtagaacacattctgtctagtcaatcatattgctagggaaacatctaatcagtttattcaggacagagcctttgaggtcatatgattgaccagtgtccatgtgtattttgcagtgagcaaataagacaactttttttctgatcagtaggttaaggagacagaggatggtcatcctatcttgcctttgctcctgtcatcactggggcttgtttgggtcacttctgtcttagaatattatactatctgatgtcatgactcactgtaaagctacattaattgtgacaacttgaaacaggatagacaaattgataaatagaataaaatagagaatttagaaatagactgccacctatgaagtgacttggtggttggcaaaggtaccaatgcaattctattgagaaagagtgctcatttcaataaatggtaccaaagtatatgaataaccatatgaaaaaaattgaaccttcggtcctacctcacatagtatatatttaaaaattctaggtggattacagacgtaaatgtgaaatactcaacagagaagcttctagcaggaaacactgagagtgcctacatgaccttgggataggcaaacattttttaagctaaagacaatagatacactaactgtaaaaaaaatactaaattgtacttcatatatacatatgtgtgtgcataaatatattcttcgttaaaaaactaagaaagttaagagacaagccacagaatggaagaagaaatttccaaatgaatatatccagcaaagaactcatatctacaatatattttgagatacctttataaattaataagataaatgcaaacaagaatacaaatgtgaacaaaaaacttgaacaggcacttcaccaaatgaaattacctaaattgttaattagcacatgaaaaagtggtcagtatcattaatcatcagagaaatgtaaactaaaactacaatgtactattactacacaacccacctgaagaatggctaaaattaaaaactttgacaatactaagtgttgaaaaagacacagagcaactgtaattctcatattgctaacggtatgtaaattggcaaaaccactgaggaaaattctccatctgtatcttctaaatcctgtatgcctatcctctgacccagcaattccacttctaggtatataacccaggaaaatgaatgtatatgtccaccaaaagagatgtataagaaggtgcatagcagctcttttcttagtagctgatgaatagaaatagttaaagtgtctaccatcagcagaatggataaacacattattgaatattcagacaatgaaatactacacagaaattaaaaaagaatgactgctgctaaccacagcagcatggatgaatcacagatatgaaagaaggcaaataccaaagtgcatgtactgtgagatttcatttatagcaagttcacgaacatgtaaaactaatctatgagatagaagacattaaaatggtagcatcatggtgtgggggtgagatcagctggaatgaggatgagggaggattcaggggttctagaaatgatctatatcttgatctgaggattgattacacagcataaataaatgaaaattcatcaagctataaacttaaaatttgtatactttatttattttatctatatttccttttcaaggcactgttctatggtttaaaatgtacatccttacctcatcatcatttaccttcaaatagtgttattccacttcacatatactgtgagaacctttcagcagtatatttccatttctcattccctttctttgtgtccttgttgttgttcattttacttctacaggttataaactcccatgatgcctgcaatgttttgctttaaacagttaataatcttttataggatatttttaaactgaaaaataagggttttgtatttatccacatatttaccatatctagaactcttcattttgtattggtacaaatttccatctggtatcattgtccttctgtctgaagagcttcctttaacacattttggacttataataaattcaatttttctttgtctggaaaagtctttattgtgccttcacttttttttttttttttttgagacaaagccttgccctgctgtccaggccgaagtgcagtggtgcagtctctgctcattgcaacctccgcatcccatgttcaagtgattcttgtgcctcagcatcccaagtggctgggattacaggtgcgtgccaccacaccttgttgattttttgtctttttagtagagacgaggttttgccacgttggccaggctcgtcttgaactcctgacctcaggttatccacccgtcttggcctcccaaagtgctgggattacaaacatgagccactgtgcctggcctatgccttcacttttaaaagataattttactgggtataatattccataccgacagttgttttttggttggttttctttttcttttcctttttctttttcttttttttttttttctgagacagagtctcactctgttgcccaggctggagtgcagtggcgcgattgctgctcactgcaagctctgcctcccgggttcatgcgattctcctgtctcagcctcccgagtagctggaactacagacacccgccaccacgcctggctaatttttttgtattttttagtagagacagggtttcaccgtgtttgccaggatggtcttgatctcctgaccttgtgatccacccgcctcggcctcccaaagtgctgggattacaggcgtgagccaccgcgcccagcctggttttctttttcttttagctctttaaggaagatttactactatcttctggttttctattttctcacaagaagctgtttatcattcttatctttgtttctctttatataaaatgtattttcccccctttggctgctttgaagattttctcttcaccactggtttttaataagttggttattctatgtcctgctgtttattttctttgtttcttctgcttatgattcattgaacttgttaggtccagttttcattaaatgtagaaaaactttggccattttgttttaaattttctgtccctacctcttctcttactgagactttaattactcatatattagactatttaatattatcccataactcactgaggttctgctctctttttctttctttgcttttttttgtgtgtatttttgtctctgtgcttcattttgggttgtttttattgttttctcttcaagttcactagcatttttttcagcagcatgatatggtttggctctgtgccccacctaaatctcatgttgaattgtaatccccgctgttggaggtggggcctggcaaaaggtgcctggatcatgggggtggtttctaatgatttagcaccatccgccttgctgtcctcattatagagttctcacaaaatctggttgattaaaagtgtgtagcacttccccctttgctctctctctctcctgcttctctgccatatgaggatagtgcttgcttcccccttggccttccaccatgattgtaagtttcttgacacctccccagaagcagaagtctgttcagcccacacaactgtgagctgattaaatctcttttctttatagactacctaggctcaggtagttgatagcagtgtagaacagactgatacaagtgtctaatctgttgttaagcctagcggtgcattttctatttcagatattataatttttatctctacaagtttcatttttaatttttaaaatatgtttctttctctcccattgtattgtttccatctacattcttgagaacctctttataacagttgttttaacttccatttctgctcttcccatcatctctccatttccacgtctgtttctattcgttgatttctccttgttgtgggtcatattcttctgcttctttgcattcctcgtaatttgtgattgaatgtcactacttttacattgtgaatgtgatgtgttgggtgctgggttttgttagattcctttaaacagtggtttagttttttctgagatgcagttaagttacttgtaataaacttgatccattcaagacttggttttaagcttttcttgggacagatctacatggagtgattgattattctagtttgcctgggattaaggagttttccaagacatgggactttcactgtaaaactgggattgaagagtttctgagaaatgggacttttagttttaaagctgagaaagcccaaggcaaaccgggacaaactggtcgtcctagatccagagcatgctgttggccagggataattcagtcccactatgaaattttgagtaacctacccatttgacaaggtctttaccctctagctggtgagcacatgggttcttcccagctctgtggattctggagattgtttcctaatggctttttcctggccttgattactttcctttcatgtatgctcaaattagttactcagcgaaagacatagatctccctggagtttgtgaggttttttgtttgtttgtttgtttgtttgttttattttttctctgcagattcatcttttcctatactctgtcctgcaaattttagctgccatggctaccctgaacttcaatctttgtatccttaactcagtgaaactgatgaactctgccttctcccatgctgttctgctgcctggaaactgcctctaggcagtaagctaggataaacatagggataattttgttccctcttacaggaatcatagtcctgaaatgcctgttgtctagttcctgaaaactgatatgtaatgcagtttgtctggctttattgttgtttaagatgggagtgtatatgtaatctctggtacttcattgttgccatatgcagaagtctttacatttcacacctccatatattttttaaatgtatatgttataaatacttgaaggagttgttctttttcagggtacaccagtttggatgctttcagtttaagcttactaagacaatggaatatttgaaaataataatggcaactatttactgagtctcagccctgtgctggatgtttcatatacattgtcttgaatcatcacaaaaacatttaaagatagatattattgatatcattacctctgttttaaagatatcaaaattgatattcaaatcagtaacttcactaaactcatcagctagtatattgaacagcttacatgtgaatgtagtctctctgagtactcatttgtccataccacagtgcctaatgtgtagtattaaaatgttatcccaccagctgggcacagtggctcacgcctgtaatcccagcactttgggaagctgaggcgggtggatcgccctgaggtcaggagtttgagaccagcctggccaacatggtgaaaccctgtctctactaaaaatacaaaaattagccgggcgcggtggcgggtgcctgtgatctcagctgcttaggaggctgaggcaggagaattgcttgaacctgggaggtggaggtggcagtgagctgagatcacgccgttgcactccagcctgcgcaacaagagtgaaactccatctcaaaaaaaaaaaaaaaaaaataccataccaaaagccttagaggtcaaaataatttgtggtgaaaaggttagctcatgcagaatatttaagtaattctgatagtagcgttttttgcgatataggtgaataactaatttgttattttgtgtgtgtgtgtgtgagagagagagagagagagagagaaagagagagagagaatgagtctaggtgcagatttctatgcgcatgtttttggtgaagtgaataaaggagctttacctggccacattgaccttcttcgagccctggtgactttgaatatgatactgaaattgcattcaattcccaaagttattattttaatttgctaggttccacaattaccatacacttagtggcttaaaacaacagaaatttattttcttccagttctggaggccaaaattcccaaatcaaggtttcagcagagctgcacaccctctgaaggctccaggggagaccttccttggctcctccagcttctagtgactctcagcatttcttggcttgtggcagcatcactccatctctgctgccatcttcccatgatcttctttcctgtgtctttctgtcttttcctcgtctcttctcttctaaggacttgttagtggatttagtgtgcctcccccgcaactcccaccagtctaagatgatttcatctgatatccttaactggattacatctgaaaagaccctagttcccaaagaggtcacattcacaggtatcagaggttaggacttggacatagctttttgaggaatacaattcaattcactacaattttcatgagagtcttccaaatggctgctctttcatattctaccagaaaggctatcaagctatcttgaagggaaggtggtttggacacctctgtgttcatttccatggtgctgaaggttttagacagttaaataacagaagaatgcccttttactttgctaggccacctttctgcttgatcccacggaagctggctaccttgcaacccaggcagttatctcctgtaattattcataaaccacaactgagaaataactctagacacccacatctgaacaagatgaacctctaacttgtacatccaagcctgagtgtgacttctctccaggtatctctctttccatttgggcagcgagacagcccttgggtccttgccacttttgagtcagagattctatcttccaagattctgtttcactccctctctgcatatatttggtgaccaggtatcctgttttgcaactttcttctaatgtctttttatctgcgcacataagcaacaacttttcttcttaattcttctttgtgaccttgccaactaagaatcttgaacatgatgggactgaatgtttaaggcattaaacttaataactaggccattaccactatttactaacctggactcattcacagtgatcttttcgccttgccacagcataatgaggttattaattacagcaagaggcgtaagtactcccggtttgctctaatgctatctggggagatggctgggtctttggtcataattcctgttaaatgactccaaggagatacagttaagttgccatgaaatgatatttcccttcaatgtaaacttttttctttaaatgggttgtttttaggtccctaaaattcccagttataagccacctaatgcctcattcagctgaacagtgggggccatggagtgtggcagttaaaagcacagggccagctgagcgtggtggctcacacctctaatcccagcactttgggagtccgaggcgggcggatcacgaggtcaggagttcaagaccagcctggccaacatggtgaaaccccctttctactaaaaaacaaacaaacaaacaaaaattagctgggtgtggtggcagatacctgtaatcccagctactcgggaggctgaggcaggagaattgcttgaaactggaaggcagaggttgcagtgagccgagattgagccactgcactccagcctgggtgaaagagtgaaactctgtctgaaaacaacaacaacaacaaaaacacaggccctggtgccacaccgcctgggtttgaataccagctctgctacctactatatgatgctgtgcatgttatttgatctttttctgcctccatttcctcatctggacaagcatgaggattaaatgaattcatatgtgtaaaatgcttaggccggtacctggcacatagtgagtgcttcatacatgtgagtggttatgtttatccattaaacccaaagaaattgcttttggcatctactgtgtataaggcacagtttggtgctatgcattttagccgatagcattataggttgacttgtcacccccaaaattcatatgttgaagtcctaacccacagtagaatgtgactttatttggagatagggtctttaaagaggtaatcaagttaaagtgaggctattaaagtgagggtagtgtatatgactggtgtccttataagaacaggagctttggatatagaaggaggacaatgtaagaagacacagggagcagatggccatctacaagccaaagagagaggtctggaacacatccttcccttatagccctcagcaggaaccagccctaccagcaccttgattttggacttctagcctccaaaactgtggagaatgaatttatgctgtttaagccacctattacagcagccttgggagactaagacaggtggttatagtgagaaatcccagggagcatgtcatctggtaagagggatgtattccatgggactctggttgtaagcaacagaaatccatgaaagctcatttaaacaaataggcaacccaaaagatgaactcacaaaatccaaaggtaggtctgtagctggcacataaacatccccatctcttgcccctgcccctctcttggtgactgtgacattcctccctctctctgtctctctccaccctggttttctgtgctttgccagtgcagatgacagaaaacatggtttgtgcattaaagatacaaccacctagaaagaaactgcatgactcactcatcagtttcaaactctcagggaagagtatctcattcttccaccccgagtcagatgcttaccccatcaactgtgaccaaaagggcagtatgtcaatgaacaaacatggtgctgctgctgtaaccagatggatggagcaagaggaggggccattaccaagagaagaaaactgggcatatgaccagggtggggggtgggtccgttaatagagagaaataatcaccgagtcatgatgccataccactgtagagcatgaaggtgagaaaatctagagaaaatgtcccatcaaacagcatctgcagagtcatgatgccatactactgtagagcatgaaggtgagaaaatctagagaaaatgtcccatcaaacagcatctgcagagtcatgatgccatactactgtagagcatgaaggtgagaaaatctagagaaaatgtcccatcaaacagcatctgcagagtcatgatgccatactactgtagagcatgaaggtgagaaaatctagagaaaatgtcccatcaaacagcatctgcagagtcatgatgccatactactgtagagcatgaaggtgagaaaatctagagaaaatgtcccatcaaacagcatctggcatgttctggtcttggagctggaattgcctcttccaccttcaaagaggcagaaattagcaaggattaaaagcataggtccttgaatcagagacacatgggcttcaatccagtttggccttgtattaattgtgctgccttggacatgccaccaggcctcttagagcctcagcttcctcatctttcaaaaagaaagatgaaaataatatcggcaacttcctaagtttgaggggagctttaaaggtgtactttgtacctctaagtacccaatatgtgttaaccgttgttaccaccgttggtatttgatgaatccttttttgctttgctttattcttcaggctgaattctcagagttgaacctagctgcctatgtgaccgggggctgcatggtggacatgcaggtcgtgagaaatgggaccaaagtggtgaggtaagtaggattaaaatatgcagaaccttctgagaattgcatacgtggaacctcatgtagcccacccctccgtccacttcctgcgacctaactcctttgccacatgtactttcctgtacagaatgtctgcttcccaggtgtggttgcagtagtaatgaccagcggcacatatcatacgtgcagcacctgtggtgtccccaagtgagccctgggcttggagagaaaagacttgggttccatttctggctttgaggctctgctctggcatattatttagtcccttttgtcctctacttctcatctgcagcatgatgatatgcactgaagttagaggctgctaaagtttacagaaactcacatgtatgacagcaccctgttaactctgaagtgcggtacgaatggaaggtttattagaataaatgaaattcaacttcctgcaatatggcagactaagtgttcatagaatcttctccaagtagaccaaaactaaaagcactagatatataatatgttcagaaatctgtttgtaatttatgctgaattggagagcaagtgaggggtttcttcagaagccaaaaatgacaagaatgtataaatccataggcgagataaacacatgtatgaatacattgctatctagttaagtacccagagaacgatacacactaggtctcatgagggtttagagaaggaagagacaggattcagatttggggaaggagggaaaacaggaaaagctttgaggaaaaggtaacatttgttctgagcctggtccaatggtagaatgtggacattctcaggctgggtgtagggaaagagaagtatatcctaagagtaggaaacagcctctgcaaataaagacagatccaaaaaaaaaggtgcatgtttggtatattagtcctttttcatgctgctgataaagacatatactcgagaccgggtaattcataaagaaaaagaggcttactggactcacagttccacgtggctgaggaggcctcacaatcacggtggaaggtgaaaggcatatcttacctgatggcagacaagagagaacgagagcctgtgcagggaaactcccctttataaaaccgttagatctcttgagacttactcactaacacgagaacagcatgagaaagacccgcccccatgattcaattacctcccaccaggtccctcccatgacacatgggaattgtgggagctacaattcaagataagatttgggtggggacacagccaaaccatatcatttggtaaattatgataattcaactaattcagccattctttattgagtgcctactgtatgccatgaaagacatttggcttcctatttccagtaacggtgggctaggtcatttggaccagcttttcccctgaaaacaacgtaaaaactgatactaaataattacagtctttaaaggccttctaagagttggtgtgacagtaaggaattaccaggaagagactgatgggaaaatgaaaacccagacaggtaaatgagtacaaagccacctgtatcctgagagtattcactagatcagccaaatttgcaactggttttgagagcttagtggaggcaagggagacagaaatcaacactcagggccactcacaatagggagtgtaacagtagaccctctccacaataagctgagattccccaaaggactacagcttctaggtgaacatgaattacaagtaggtgagccctcacaagtacttgcagcttgaattgcagtttgaataccccagccctccaggaaacctcaggcattgaacttggtttatggtgatcccagacatgccagaaataaaagcaaatcctatgtaaaggaaggcactttcaagctaggcttcaaatgatccttcaaataatttttttgtataatagctagtacgtagtcaaagataaccaggtgaaacaggaacaatagacaatggagacagaacctcaaagacagaagacattagaattatcacacaggttatttttaaaaactatacatatcaaattgaaaaaaatcaggtatggagatatctgcggagaaaaggacactaaaaaaagttatataaccaggtttttgtgtttgtttgttttgagatggagtttcgctcttgttgcccaggctggagtgcaatggcatgatcttggctcactgcaacctccgcctcccaggttcaagcaattcttctgcctcagcctcccgggtagctgggattacagacatgcaccaccacaccaggctaattttgtatttttagtagaaacagggttttgccatgtcggtcaggctggtctcaaactcctgacctgaggagatcccccggccttggcctcccaaagtgttggaattacaggtgtgagccaccgcgaccagccgatacaaccattttttttttaaacacaacttctggaaatgaaaactacagtaatcaaaattattgtgtttaacatcacattagacatggctgaaaaagcgtttatgaaatgaaaggtacagctgaagagattatcctgaaggaagcacagagagaaaaagatcggaggtgcaggaaagactgttagattctaggagagggcctaatattcatttaatcagaatctcaaaagagagaggtaaaagagaatagagcagagacagtatttgaagaaatgattgttttggaaagataccaaaccaccgaaagcagaagcttggcaaatttcaagcggataaataaaaataattccacaccaagactcaatagtgatatttagaaagaaaaagccagaggaaaaaaggcagattacagatggtccccaatttacaatggtttgacttatgattttttgactttgtgatgatgcaaagtgacactcattcagcagagcattaataaattgcatgagatcttcaacactttattataaaatagactttttgttcaaagattttgcccaactgtaggctaatgtaagtgctctgataatgtctaaggtaggctaggctaagcgatgatgtttggtaggttaggggtaataaatgcattttctttttttcttttttttttgagacggagtctcgctctgtcgcccaggctggagtgcagtggtgcgatctcggttcactgcaagctctgccttccaggttcacacccttcacctgccccagcctcccaagtagctgggactacaggcgcccaccaccatgcccagctaattttttgtatttttagtacagacggggtttcaccgtgttagccaggatgttctccatctcctgacctcatgatcctcccactttggcctcccaaagtactgaggttacaggtgtgagccactgcgcccggccaataaatgcattttcaacttaggatattttcagtttacaatgggtttattgggatgcagcccctttgtaagttaaggaacatctgtacttttgttaaagtaacagactggcagcttcctgagaacagtggtggaaaaatgtcttcagtgtgctgagagaaattaattgccaacctataattctatcctcagagaaacatcttttatgaatgatggcaaaataaaaacatttacagaccttcacaaagggaaactgtaaagtatgtatgtactttaggcaaaaataaaatgacctcagattaacgtagagctgcaagattatatgaagggcaaagaaagtggtgttaataggtattgtcttcaaaagacaataaaataattttatggatttaaaaatatatgaaggattaaaatatacaacattaagttagtagagattgagggtaaatggaattaagatattctgaggcccttgtattgtcagggaagaaagtaaacatggccaggtgtggtggctcacgcctgtaaatcccagcactttgggaggccaggtgggtggattgcctgcactcaggagtttgagaccagcctgggcaacatggtgaaactccatctctatgaaaaatacaaaaaaatagcagaaatcctcccagctactcagggaggctgaattggtagaattgattgagcccggggaggtcaaacctgcagtgagctgtgatcacgccactgcactttagcctgggtgacagagaaacatcttgtctcaaaaaaaaaaaaaaaaaagtaaatatattaatagcaggctttaaaaaccaacacagaacaggtgttgtaaataacacaaagtaaatggttgatttacacccaatataacagcaggtctgatctgatatcattctgaattgcttatacagcagtgctggttattaaaatattgaaacttttctataccggtaggtaaatagccattgccttgagcctactgagtgacttcagccaccttaaccccatgagactgttcctgtgtcccccagtccaccacactcctgtccccaagcccatattcttgttctcccctggccacaggatgcccagacattgtagggaagaacctcagaagtagtagtggaaccccagagagtgaatgcttggtttctcctgtctcttcaaggctataaatgcctgtgcatcttctggattcgccctctcatggtcatttgtgagaactgcaaaccccacaaagtactctgggagttgttaaatatttgtgtcaccagtgtatgtataccaataattacattaaatgtaaatggactaaatgcactaattaaagagaagagttatcagtgtaacttttaaaaaatctaaatgttttccattcaagacattcatctaaaatataagcatatagaaaatttgaaagttaaagaaaggggaaaaatataccatgcaactgtgcagcaaaagaaagctcactgatgcagctgcattaatgtctgggggaaaaaatagactcgaaggtgaaaagcattactagggaaaaggaagtaatttattatgataaagattcatttacttagaagaaataattttaaatgtataagcactatataaaaatacctcaagatatacttcaaaaatggacaaaactataaggagacataaagaagttcctgattattggagattaggagaataatgctaaatatatactttcatgtacttcttcatagcaccctcattttgcacacaagtactataaaaagcctaaaatgctattgtttaggaatctgtgctcatatttggtattttttgtactcgtgtctgcttccctatttggtagggtggctggatctccttcatttgtaacaggtaaaaacaagaacatctatcccggctgggcacaatggcttacgcctgtaatcccagcactttgggaggccaaggtgggcagattgcttgagatcaggagtttgagacaagcctgggcaatatggcaaaaccctgtctctaataaaaatgcaaaaattatccaggtgtggtggtgtgcgcctgtagtctcagctatttgagtggctgaggcatgagaatcacttgaacctgggagcggatgctgcagtgagccactgcagtgagcctggatgacagattgagaccctgccacaaaaaaaaaaaaaaaagaacaactatcccattggtcctcagatttagctacagattagaatcacctaggaattattttaaaatcctgatacccaagcagtgtcccagacgtattgcactggaatctctgagggtgggatttaggtattcatatttttaaagctcccctcgtgattctagtggcagccaaagtaggaaacatccccagattgttctcaacatggccctgcactgaggcaggacgggctgaaaagctgaggacactcctaggtatgctgcctgaacacaagaatcactttgcaaaaatagacatcttcaagtcttattctagacctgccatattcttcctgaatttacaacattgtttacaaaaataaagttacagaaatgttccaggtatttgctaattggcagttcttccagcattcaggaatggcagactttgaaggcagttgttatgagatgaattatgctcccctggaaaaagatgaagtctcaactcgtagtacctcagaacgtgaccttacttagaaatagcattgttgcagatgtgatgattaaggtgcagttatactggagtagtgtgagcccttaatccaatatgactggtgtccttataagaagagggaaatttagacacgggaaaacaccctgtgatgttggaagcagagactggggagatacattgacaaaccaagaattgctgacaatcatcagaagctaggagacaggcatctcctgccaaaccctcagaaagaaaaccaactctgccaatagcttttttttttccttgagacagggtctctctctgtcacccaggctggggtacagtgatgcgatcactgctcactgcagcctcaacctcctgggctcaagcggtccacccacctcagcctcctgaatagctgggactacaggcacatgccaccatgcctgcctaagttttaaatttttggtggagatggggtcttgctctgttgcccaagctggtatcgaactcctgagctcaagcgatcctcccaccttggcctcctaacgtgctgggattacaggcataagccaccaagcccagcctgccaacaccttgattttggacttctagcctctagaaccatgagagaataaatttctcttgtttaaagtcattaagtttgtggtcccttgctacagcagccctagaaaatgaatatagcagtgcctcttgaaatttaatgtgtttacacacctctgggagatctcatgttaaaatgcagatcttcatccattatgtcttcaggtatggcctgagattttgagttttctttgagctcccagatgaagccagtgcatctggtcttgcaggttcagtttgagcagcaaggatgtgaacaagctcctggatgctgctgatgctgctgttggaagatcacattttgagtagccagggctgtgaagacagtgccagtatagctaaaggcctgggttcagggacccatatggctgttgagatttattctgtctcatgcccaggatggtgcttacaatctcagccaggtagctcactttagcaagatttgttacaggatgtcagacccatgagaatgtgcacacacactaagtagcctgtgactcagtgtgtccttcagtggggggaatcagtagaatcttccaaagtaccatttgatccagcaatcccattaccgagtatatacccaaagaaatataaatcattctaccataaagacacatgcatgcaaatgttcattgcagcactagtcacaatagcaaagacgtgaaatcaacctaaattcccatcagtggtagactggataaagaaaatgtggtacatatacatggaatactatccagccataaaaaagaaggagatcatgtcttttgtgggagcatggatggagctggaggccattaccttagcaaactaacacaggaacagaaaaccaaataccacatgttctcatttataagtgggagctaaatgatgagaactcatggacacaaagagaacaacagatactgaggcctacttgagggtgaagggtgggaggagggagaggatcagaaaaaataactattgagtactaggctttgtatctgggtgacaaaataatctgtacagcaaacccctatgacacaagtttactggtataacaaacctgcacatgtaaccctgaacctaaaataaaagtttaataaacaaataaataaaaacagtggaatcttccacaggcatatagggccataacaagtcctagctatggtctcccaaaataggaatgttaaacagtgctcttgacttgctgtgtattctttcaaagacatgtagacgttgtattgaaattgcctgtaagcacttccagtatgcattgtgaccaaggtctagatctcccgaagtcttgctcacaaggagcaacttcaggaatggtgatgtgatggttaatttacccagagggctggtaaaactttatttcttgttgcgtctgtgagggtatttctggaagagcgttggaatcagtaggctcatcaaggaagatcttccctcaccgtgtggtcagacagcatccaatccgctgggggtcccactagaacaaaaagacagaggaagagctaaatctctctctcttgacctgggacacctgtcttctcctgcccttggacatcaacgctcctggttcttaggccttcagacttcaagactgatgccagcagccacccaattctcaagactccagccatagactgggaaattatacggttgacactcctggttctcaagccttcaaactcagaccaaatcacactatgagctttcctggttctccagctcacagccagcatcttgtggaacttgtcagcctctgtaatcatgtgagccaatccccataataaatctcctctttgatatatcctgttagttctgtttctctggagaaccctgactaatataggtgaccaggatggatggcagagaagatcattgctggctttctccagcttccattccttctgctttggcaaacagcacctaggattccattgaggtgaccccctccccaacttgcagtctgtgtggtgtgtgcagctgatggcacatgactagccccagtcaattggaatatctcactgggacccaagccaggccagtgccagaactcttggatgaaaggcacatgttttctgctgggaccacagagcggatgggatgtatgtctggagctgctggtggccatctctctccttgagtgaacaatctgccaagaatgaagccaaggtaaaggaacacacagccaagcagagagacgatgccctgatgatgttattcaaggctctggatccggacttagttgagccaaaaaaaatccctttttgtttaagccagcttgaattgcacatacaaaattcatgaacttttatttatttagcaaacacttttatagcatttcctacgtgctaggcactgctccaagcacttaacatgaattaactcatttcatcctttcgacaaccctatagggtgtgtgctattaaaatcaccattttatagataaaaaggctgaaacaccaatggatggggtaatgacatccagttctccagccaataagtggcaaagctaggattcaagcccaaggcagtctggctccaaggcctgtgtgtggcaaggggcagagctgcttaaagaagccatatgtctcctactatgaatgccatgcaagagtacaatcgaacaacgacatggaagaaaaatatggagaggatccatgcatctgacttttaggtggggaacaaggaaaagtcagtcaccactattgatggcaccttgtgcaccagggctgtgctaagtgcccatcatagatggtcttcttacctagttgttacgaactcatgaaatggcctaataataatgtagacagccagtatagcctgaaggttaagaacacagttctggagcaggctgcaggctgccttggtggacatcccagatttgccacggtgacagcagctgtgtgaccgtgggcagtaacttatctgtaatactccccctcctcctcctaataataataataacaatacctcctcatagggttgcagtgaggattacatgagttagtataatgtgaaatgctaaacacaatgcctggatcaggataatcactaaattaagtgtgtaataataattattatagccccatttagagaggaagaaactgagtcacaactgggacagttaaatcattgtcattgatttcattgccccagatcacacttttagaaagtagcaccacttggatttgaacccaggtctctgattctataccgagtgaatttccaagtgtcttcgaatctttgtccactccaccagcctctggtcctgttgagcccacaccaggctggcgtgagtggacactcagtctctgtacagaaagcagcagtatgtagagatttctccagggtgcagagtgaagctacagctcattcagggtacagtatgggagtgttgccctcccttaaaaatctgttgctcaggtatgagaatttacctctctgagcttcagtgttttttaatctgtaaaaggtaataatattattttgcatagtttttgtaaggatgacatgagatgtcatctatgaaaagtttgtgcattcattccacaaacatttattaaggacctactatgttccagggaccacttcagacattgggtattgtatcagacagggaccaggcaaaagacagaattcacccctaaatggtctaaataaagagactttaaggaaggggcaacttatggaggagtgtgaggggctaagggaacgtgaggtatttagaatctgacaacagaaggaaaccattatccctaggggtgaagggacaaaaggagagaatagaatttctagactaaatctagtaggtttaatctagacttgagcaggagagctggtccattgaagctataactggggaggaactcagctaccttcaaagtcatggcactaaagcacagtgggcactagagagaagtaccacccccttctctccctctgccttccagtctcctgctggggcctcactttggccaaaggcaagcagaaacctttcagcaagggagctgagttgatgctgccaacagggacccatctcctgtagctcagagcagggcagagaagagtggaaaaagcatagaatggggtcaggagggcacaaaaagagaataactcttaggggaccagtggacaaaatagaccaggtccctgcttacaaggtcagattctaggagtgctttgtaaatggccaagcattgtacacaagttggttaaatcaccagtatttgcagcagctgtcttgatagccctccttcctctggtttttgtccaaacccaaacccagggtggccagccagccagctcgaggtgcttaagcgcaacccagacatccaggttctctatttagaaagcagagcaggggccatcccggggcatgttaaaattcatgctttgtgagtgccttcgctgttctggacccaaattctagcctggccccacaagggagagataaaaagggacagccatgtttatacagacagaagggattgcaaatacagggcaggagaaaccaagaatgaaaaacacccgaggaggcagacgttaatgagaccccaatctaattacgcaagttctgctctcagtttccagcattaggcaacactaaattataggcacccgttcaaaccgcagcggctgataatgtgcatccgctcattagaaggtcagacctcagagagggctgaagagcaggagccaggaagcatcagtaatgcaagaccttgacgaaaggcatcagagtctctcagatcctccccctccccagctcccacccaggcttactgtttgtagggaggatgtttggggcaagagggagatgcatgggcttgtcccagaggaggggatggtctataaaatcttagagttccagagtcagaagagccccttagacttttctatgtgtccccattttacagatgggcaaactgtgacttagggaagagagaagggtggcttttccaaatcctcccagcgtatcagcccctgagccacaatgagcccttgactcctgaatctctatcctgggacttctctaacatcccatcaagaaacttaatttttataataacatttctttactccttatttcatacataattgcccagattcttctgggcttcctgaacttttaatttcaaattccagatatccattcattcaacagaatttattagaggcaaatttcgagtgccaggctccagcaaacattacatagaacacagttcctgcactcactcccaggtacctgtgtgtgtgtttggaaaagtgttcccttcacctcttctaaatgtctctgtatgcattaagctgcttcctcctttccttcctttcattcattatgtgccagacacagagggtacagtggtgaatgaaatagacagtagctcctgtggagctgatactagagttgcagaaaacaatcaataagtaagcagatatgtgggctaagggcaggtcatgagaaacaggtgaagcaaaagcaacagagaagttggtatttgaggtgtgggaagcagggaaggcctcctgaggaggtgacttgagtggagaggaaaacagagtgagcagagcgagccccgtgtgtatggagggtggagcttccctctctctcaactttgggtggacatgcacacaggtaagtggcagcttgggggccaaatgaggggaaggagaaaggcagagacttccttggcttggcatgtaccttgctctcatccatcaagattgtgcttctgtgcccgcttctctccctccctgaagttgaatttggtgcccacctccgagctcacaaagcatctaggactagcccaggtaggcggcctggcttcatggcacagaggccacctgtgtaggcaaagcagaccgcctgggctggatcccggctctgccttctccaagctgcaaggccttcgatcagtcactccctatttctagctcttggcctccccacctgaagtggggacagagtcctcacttcatagatgtggtatgtgtaaagcatgtccatggtgtctgtgttactagctcggcgcttgctagttctccttcttcctgaaacatttctgcagatgtgaccactcttacccatgcacctcctactgagtttctgatctcatgtcgcctcctcagggagaccctgccagaccgtgctgtccgcactctctaggcccaactatgcattttttttccttcaaacatttatcactgcctgaagcgattctagctagatcgctaatacagagacatataatattaaataatatagagatataagatatgctattgtataatttattttgttgtttcttttctagaacagaaggtctagatagccagaaagattgctttgttcccactatattcccatatcacatatcaggttctcaataactatttgttcattgaatgaaggaatgcaccagcccttcaccaacagctatgtgttctggtcttactgctcttcctgtactataactgattcaggagggtaattattatttacttcccccgtctccccctggactgaaccttccttgaggatcaagttaagctgtttttccgaattgtggccccagcacctggcacaatgcctaaatctttgctgaaggcattcatgaccagccgactctttgcatgaataagaatcctacaactctgcaaagtgaaaagctcacggctgaggggagtcaggccttggcttgcaccaggcacagacttcctgacagcccaccacccacagccttgtgtccccaggcggggatgtggtctgcaaggtcaggcacttagggtcgtccaggggcccagcagagcagccttggagggggaagcccccatctaatctcttcacccagggcctctgcccttgccactgccggagaaagcaggatccctggggacttgcagaggtggggcgtgggaacgggaagagagcagcacaagaaagaggcagtgtgagcctgtaaagcgatgccaggctccgctgctgtgcacctccagccaacaggccagcggcagatctgccaactcccctgggagagagagctcgggtccgacagagaaaaacagtgtggctcctgattcccagaagcacagaaactggggatgggaaagactgtgaggccgctggctgcgccccgctgaccctgtgcactttcccatgtgctggagccacacccggaatgactccagctctgggtcccactccaccaccccccaagaacctgtcctgccctgacatatgccactgtgggagaaattgcccggtggccacttcagacttttggccttggcatcctggcgtcttctcattcagaagcaatcaccttttactaaaaggctgttgggtacccagtacttctcagtggtaggacatttcatcctccctttgaaagaagtgaaatgacgtttttccgaggccacatagctgacaggtggaggagtaggtctccagttctgatatgatttcatatcacacgatccttccacctggttgacacagcttaatattggaaaaaaacactagcattggtgtctggcagtcctgggttcaaatcttgacttcccgtttgctgtttgtatggctttgtacaagtaatcttacctctgactcccaggttccttaactgtaaaatggaaataatgcctctttttgaggactaaatgaggaagtctttcaattgttagtgcctgaaatatagtgaatgctctctgaatgttccctctacccctgcttcatctcataccccacaactagtcttgtacacccttccctgctccctgagatgagcctcatggggagaagagttggggggagaccatcttagggccccctcctcacccaggcaacacagtgtagtgaggagagccccacaacagggatggagtgctccatttacagtttgcatttactgtttgcaaactctctatcttcatttaaaatgtccatctgcttcctgagggcttgttgatccactagtttattgacattcaaacctttcgtgatgtgaataatttaggaaacctctaccctacttattaaaatgcaaatgcttgtgccctggtaccagaaagtcagattcctgggtgagacccaggagtttgcatgttttcaagcttcgcctaagtgactctagcaccaggggtctacagaccccactttaaaagccattgcacagctagcctgggaaaaatagcagcatgcaggcaactaaaacacagaataacatgttgtatgattttattttgttctatgtggttttaaaataaatgtggaaattttagcaacagtcataaaccaagaaaaaaaattgaacttgcctagagaagttataagttcaaagtctagctcaaccacttaccgacagtaattatttcctttctggatctgtatcctcatttataaagtggagatttgtataaagtttttttgtggaacaaactaccccaaatctttgtgttgtaaacccacaaccattttatttgctttcaatctgtgggccaggaatttgggcagggcttagctgggtggttcttctgctccatgcagtgttgcctgggatgactcacttgactgcattcagcttgtggcttggctgggctggaaggtccaagtaaacttcacattcagtctgttgccttggtgctccttcacgtggctattgagcttcctcacagccatgtggtctcagcatagtcagatttctcatgtggtagctggttttcaagagggcacattacaagaggggcagaagctgcaggtatcttaaggactagcatcagaagttacacagcacaacttctccctcattctagtggtcaaagacaggcacaggggaaacctaggtttaaggacaccccacctctcagtggaaggagggccagagaatttgaagacatgctaatccaccatttcccccttcaatctgttctctacacagcagccagagtgattcttctgaaactaaatcagatgccaaatgcatgtttaaaactctacaagggcttcccatccctgttagaatgaaattcacaatcctgactatggtttgcaaaacctcatatgatctaggcttctgctgctgcctctccaccctcctgccccttacccacaatggtacttccatcctttgctgttctgtgtaggtcaagcatattctctcctcagggcctttgcacttgctattccctcaactggaaagcttttcccctagatattaacatggctctccccttcactacatttcggccttgctcaaatattaccacttccttctctgaccatcctacccagaataacacaggtggatctctataccgtcatcctgctttattttttaacagccctcattgctactgctatgcttgcttatatgttccttacccaacctctggcaccagaatataagccccttgagggcaggaattttatctgttttgtaaataattcactccatccctagtacttagaatgaatggcactattttggttgaatgaataattctttttttattattattatactttaagttctggggtacatgtacagaaggtgcaggtctgttacataggtatacatgtgccatggtggtttgctgcacccatcaacccatcatctacattaggtatttctcctaatgctatccttctcccagacctccaccctgcagcaggcctcagcgtgtgatgttcctctccctgtgtccatgtgttctcattgaatgaataattcttatagcctgcttttaaaaaaataacttgcacttgagcctgccttccccaccagactgtccggtccctgaaggcagaggtcaagttgctttcatatttgcagccaccagctgcagcacctggttatatgagaactgttgagccttagtttgagccccactccttgcttgaagctccaaatttactcttttagaaatctctatagccttcctttgttttcaaacatgtatcaagttcttactatttgccatataatgtgataagctagtgagcttccatgcattttccaacttaatcctcaaaacaactccacatgggccaggcatggtggttcacgtctgtaattccagcactttgggaggccgaggcgggcggatcacaaggtcaggagattgagaccctcatggctaacacggtgaaaccctgtctctactaaaaatacaaaaaaaaaaattagccgggcatggtggcgggcgcctgtagtcccagctactcgggaggctgaggcaggagaatggcacgaacctgggaggcagagctggcagtgagccgagattgtgccactgcactccagcctgggcaacagagcgagactccgtctcaaaaaaaaaaaaaaaaactccacatgatagggcctgttactatccccatattacagatggggaaactgagtcacagagtagccaaataacttgcctgaggttaccccaaaagtggagaagccagaatttaaatccaggctggcttattctaaatccatgctcttaacttctacaccatgctgctttctacatgattgagtatgactatgactcgtcttttttgtctatttcaaaactgttctaagcatgctcatcccatttcctctgttagctcaggtttgtatcttttgattctctcttaagccagcgctgtcacttacattggacaagttaacgaatcttgctgtgccccagtttccccaaacacaaaatggagataataatagaaactaacctaagttatggttgggagagtgaaatgagctaattcacattaaacgcttacaaacatgccttgcaacaatgccatatagtcagcacccaataaatcttagctacgattattgtcgattttcatcaaagcacaaaacacaactttatgcttggaacatacgcttgttttgcctctcccgttaaagagtgagacttttgctatttttatttgttcctgccaataaacagtgagacctgccacaaaacggcaccacaggatgcccactgtgcctgcacaaagagctcttgtgtcctgacaccttttgcggctcttcgcattgtcattcttccccactccggcagcatgaattgaacgcctgccctgtgccaggctttctgtgaggcatttccccacacactgtgtcactttatattcttgtccccatatcacagatgaagaaactgaagctctcagagcttctataacttgcccctaagagcccagcaagaaaatagaaaaacctaactggcccacattctcctctgcctgcccccaatctcttctctacacaggagccagagagtttttctgtttttttctttaaaaaaaaaaaaataatagacttggctgtgcggggtggctcatgcctgtaatcccagcactttgggaggccgaggtgggcggatcacgaggtcaggagatcgagaccatcctagctaacatggtgaaaccccatctctactaaaaatacaaaaaattagctgggtatggtggtgggtgcctgtagtcccagctactctggaggagtgggaatgaatggtgtgaacctgggagctggagcttgcagtgagctgagattgtgccactgcagtccagcctgggcgacagagcgagactccatctcaaaaaaaaaaaaaaattaatagagtttacatcttagagcagttttcagttcatggcaaaattgtacagaaagtacagtttgcataggcctctgcccctacacgtgcaaagcttccctccctcactatcctgtaccagaggggtatagtttttataatcgaacctcatctacacaccatcgtcgtccaaagtccctagttgacactggggctcattcttagtgttatttagtctatgggctttggcaaatgtgtgacatgtatctaccattgcggtatcgtatagaataatttctctcccctaaacatcccgcattccacctgtttatcactccttccacccaaaccttggcaaccactgatcttttcacaaacttcgtctagttttgcctttgctagatgtcatgttgttggaattattcagtatgtagccttgttagagtgagactttttttttttagagaaaaggtcttgctgttttgcccagtctagaatgtagtggtacaatcatagctcactgcagcctcaatctcctgagctaaagtgatcctcatgcctcagcctcccgagtagctaggcctacaggtgcatgccaccacccctggctaatttattattatttttagtagagatgggggggtctcactatgttgcgcaggcttgtctcaaactcctggcttcaacttaccctcccacctcgacctctcaaagtgctgggattacaggtgtgagccaccgtgcccagccaagagtgagtgctttaaaactttaattgttgtctcagtttcagccacatttttctcagctcttcaatcttcatctcttctttcctatcccaggccccacgtattctgtttcctctgcctgagaagctcttcccttcttatttcaccaaaaaaaccttctgctcatcctttcctcagctcaaatgtcactcctcagagaaaccactgatgccctctcatattgacctccatcgtgcccaaagctctgcgggcaactatcagtctttactgagtcagtggaggaactatatgtatagctcccatgtattaagcacttgctttgtgtcggggaactgtgctgggcactttgcatgtattatttctaaattcttacattctcccttcttgatgcgtacgataagctacatcttataaatgtgagatcaaggctcagagaggttcagtgtcttgcccaaagttcgacagcttatgagggtggagttgatatttgagtccagctctgtctgaatttaaagtccatgttctgacaactacaccatgccaccttctttttctgacgtcggagtgggtgttgggcctctgctggtgacagagcattggggctttctgagtgggtgggctggtggctgcccatttccatggttcaagggtcagaggagaggctgtcacctttttaatacggtgcagcagcagctctgcagttgagcgatcacagcatttgttcaccacatgatggtttggctcccgttcagtttcccggggagagccgtgcagccatcttttattaccaccctcggagctgagagaaagaaacataaagagataaagtgactgtgtggcttgcatttgcttcctgcctgcgctgcctccatgctcctgctgcccccctcccatcccaggcccccacaggcatcagggcaaggttgagaccattctttgtctcccatctggccatgtttattctctctccaccaaacactgaggcaggagaagagtcaagatggctggataaggttgcacagcttgtgcaccacgcaaaggcatacggtgtcctccaagtggggattgaaaatcagcctgatgtctgcttacctgtgctctagcttggggctgcccctgccctttttctaatttgcacagatgtcttataggtcagtaggaaaggctggagaacgtggcttgcaggaaagaacattggatatccctgggctctgttaaccaaatacctcctttctgtgtgggatctgaatttgcaaagatgcccagaccccagactgctgacaccagagctcctataagcataaatcactatagtcatcattagcaactcttctatctagacttggaactcctcgtgcaaattgctatgaccctatgtctgtgtgtgacttcttgggtcaagagcaaagcagtttaggcagggtgttaagaccacaagccatgcagttaagctgacctggattcaggttctccctccatcacttactagctgtgtgatctaaggtcactcacttcacctctgagcctcagcttcctcacctgtgaaatagaatggtgcttataaaggttagataaaatctaggcagccatgataaaaatggctagcatcaattgtttactatgtacctgccactgttctaagcacatttagagagattaattccttgaatcctctgaacgacctattttccagatgaagaatctgaggcactgagaggttagctattcagttggtgcaaacataattgtgatttttgccattactttcaatggcaaaagcgcaattacgtttgcaccaaccgaataactcgtccaaggtcagacagctgctcagttggtgaagctggggtctgaatcagagctgtctactaactcttgaagtaaaagacacagaagtaaagtccagtcccttgcacaaagaacgtactcaataaataatagccattgctgttatcagcaggctaccaggatccaaggctgccagggcaggggggaattctacagatcatccatcatgtcatgtggttctcgaaccctgttccacagaggcgcctcctagtttctttgagctttttgggggtacggggtgctgagtgatcagaattccagctctcctctccccacccccatctctttaacccagagaattagttataaacactttcatctgtttatatcttaaaattccaagtaaaaatgtttccagaaaagagttccactgccagacaagagtttaaaaacacgtgggctagcctaacccattcattttaaaataaacgtgccacagagagggcaagtagcgtgctcagtgacacacagagtgagttggagactgtgccagggcagagctatttcctgatttcccagagcagtggctttttgctaagcctccttcaaggtcttgttttttcccctccagtgccaacccagagaatgtattttgcttgcatttcccagagcccctcattccaacgcgccttctcgcagtctccgagcacaccgcttgtatgtgcgtctgactagggtacactcttcatgcaaatgctgacaggtgcccccagtcccaggccgaccgacccgggaactgcactgcttcacaaaggcgagtctaggaggctgggctcatgctactggctctgtctctcgccgtgatggtcggacttgagctcaaagaggagagaaggctgacaggttcatagtgttaatgggatacatttgagaaatgctaaaccaacagtgtttggaaattcaggccagcagccaggcactgagccggccaaatttcagctgggggtgaggtaaggggtgggggggcgggggtggcagtatattctgagacagaattagagtgtcttttaaaaactggatgaagacgttgtttattcaagaccctgggagagcaaagataaaacatgcctaatagatttggggtctttccgcagacagctctcctaaactgtctccatcatcgtaataaagaattgcagccatccactgaggcctacggtgtgctgggcagctttgcctagatcctgtccctgaagtaaactagcgcacagattaggaagctgaggttcagagaggcaaagtcacttgctcagggtcacacagctaatggttgtgaaggaaccgggatttaacctgcctttaaccactgggttatatccaatgttcaacaccaaagctcagagagtggagttatgtccacagccagaagagaacagaggtggagtatgaacccaggtgtatctctaaagaccatgacttgtcaactgtatcttgctgtgtacctccctcatgggtgcccatgcgtccttctttcccagggtttagcatgccgcctagtccagggaaggggcttcgtaaatgttgactgaatgaatgaatgaatgagcgaacctcagtgtatcatattgtggtgaggcctatcaagcctaaagaaagaattagatggtccttacttgggaatgtccagtctttctcttggggtctcattgctatgataatctgccctaacagcctaaattaattgataggtttagggttttttaggatgtcttaattctctgtttacctagtgttctgcttatcccaagttagttagagtgtctcaatggtctccatctaaatccatagtattaaccagcttaaactgcttagcccttgaccctagaggtcagggtcctaatctgttttcagctttgcagcccacgtggcctgtcaccgctacttaactctatcattatggcatgacacacacagtacacatatgattaagtatagctgtgtcctaataaaactttatttacaaaaacaggtgataagccagataggacctctgggctataatttgccaatctgtggttaaaggtatggccttgggtcagatgtggagtgtatctgtagttccagctacttgggaggctgaggtgggaggatcacttgagcccaggagttaaaaggttgcagtgagctatgaccataccaccgaaccccagcctgggtgatacagagagacctcatctcttaaaaaaaaaaaaaaaaaaaaaggctaggcgtggtggctcacccctgtaatctcagcactttgggaggccaaggtgggcggatcacttgaggtcaggaattcgagaccagcttggccaacatggcaaaaccccatctctactaaaaatacaaaaattagccaggcgtggtagtgggcacttataatcccagctactcaggaggctgagtcaggacaatcacttgaacctgggaggcggaggttgcagtgagccaggatcatgccactgcactccagcctggaggacagagtgcgactctgtctcaaaaaaaaaaaagaaaaaaggtatggcctcttggagtgtgcctgtctgggttaaaatcccagctccagcccttactggctgcattgacattggacaaattataaaacttctgtgtgcattagtttcaccatttgtaaaatgtggatgataatgatcttcccttatagggaggttgcaaggaataaaataatactataaggcacttaaaaatagtgtctggcactccataattgtcagcctctataatcgttagttacccatagacagagtggtgtatgttaccctgtaatgatatcaatagcagccttttggggccatgtatggtaagaattggatgaggtcatttacgtaagctccattagagcaaggtttttagtattttcttctttattgttttttatttccctctaataaaactatttacagaaacaggtgagccagcccatgggccatagcttgttaatttgatattttttaaaaaatattacactaaaatattgtttcccttgattagtgaattttttggctccctactcccaccttagattcagttcccaaggtgagtgcttcactcacctcccagcctggccagagcttagagcagttcctggcacatagtaggcatttgctgaatgtctgttgaatgcatgaaagtacctggaaatggggcctagcacagagtgagtcttcaataaatggatcttcccacagtgtttgcatgctgtaggggtttagaggtcaagcttgggaatcagactgcctgggtccatgttctggcccagccacttactgtgtggcttttcacagcttcttagcttctctgtgcctcagttcccttatatgtaatcctaggctagtgaaagtaccttccttagaaggatgttgtgaggatattaaatgacttaattcacttaaaatgcttacaggaatctgggacacatgatgagcacacaatagatataaatatatctattaattaatggtgggaatgtaaattagttcaaccattgtggaagacagtgtggtgattcctcaatgatctagaaccagaaataccatttgacccagcaatcccactattgagtatacacccaaaggattataaatcattctattataaagacacatgcacatgtatgtttattgcagcactattcataatagcaaagactttgaaccaacccacatgcccatcaatgatagactggataaagaaaatgtggcacatatacaccatggaatactatgcagccataaaagaggatgagttcatgtcctttgtagggacatggatgaagctggaagccatcattctcagcaaactaacacaggaagagaaaaccaaacacctcatgttctcattcattagtgggagttgaacaatgggaacacatggacacagggaggggaacatcacacacccgggcctgtcggggggtggggggcaaggggagggtgagcattaggacaaatgcctaatgcatgcaggacttaaaacctaggtgatgggttgataggtgcagcaaaccactatggcacatgtgtacctatgtaacaaacctgcacattctgcacatgtatcccagaacttaaagttaaaaaaagatattaatatatttactatttttcccctggggttaagcatcactgatgggcaaaatggcaggaatgaatagggcatctaaggaagaactaagtagaatcatttcaaataagtggaattttccatttttaaatcctggtgagcattagaactatctgatgagcttggctaaatgcaggttcctgttccccactccaggggatcttgattcattgtgtttgaggcccaagaatcccctttttcaacatgctaagtgagctgtgttgcagagggtcccaggagcacacactgagaaatgccagatcgttgtttgcagggaaagacgtttctctcttccaggtcgtgcgccttcctgagaacaaccagaccagctacttcctgccgcttttcttccctctgtgtccttggaggggatctgcttccaggtggggtcagttagtttcagctgctcctaggtctttcccatgggcctctagctgtgcaaaccttggaatttttgtaccagagtttcccagttagaatatccagggctctgccaatgataccaaacctgctgcacctctctgtgaatgtccgacctctctgccatgggatgccctgcaagctgaggtttcctcaggatacctgactgtgattcatgaatgaaagggcacgaacccttagagggggtgccagtatctcttcttcaagacccggggaagttagtgcagcttgaatctcaggccagagctgcccatataggagggcagaggcagagtgcagggaatacaggctcttgcagccacacagacctgcttcaaaccctgtggctctggtacttatcagctatgtgggagccttggataagtgacttactgaccatgtgcctcctaagctccacttctttaaccagatagaatcatgccctcctggcaatgcgcctgtgagaatcaaatgcagtgtgaaagcaaaacacccagccagtgtctggcgcacagcaagtgctcagagcgtaactgtgtctgcagtcaggaatttgaggcagggtggagggtggcaaccaaggtaggtctctttccctctgtccccctttgtcttcctgaccatgcagactctttgccttatgctctgggacatttattggttccctaagtgtggtttttgtcctcccacctagattgcaggctcagtgaagttgcaagttagagtaatactgtgtaccactttgccactcccctaaagtttattgaatagaaactttggaggaaacaactgaaggtgggcaattccagtttctctattattttccccaaaataccttatttgtatcctccttcatttcaatgactaagtgaaataatgtgggacagtgtctgactcatacaaaatattgcttttttgtgagagtatagcaaattcgagctcgcaagagactctttagttcacttaattccaccctgtggttttatagatgagaaaactgaagctcagagaggggaaggggcttgcaattgggggttctcatctgaaccacagaacacaaaagcacataatgatgactattttcacagttctctgagggacggtatataatttgtaccattatccatggacaggagggaagttaattcattgcatgcaaagaatgccttacaacactgacactttattgtctaccaggacaattgcgaagggctgagcaaatgataccagagctgtggctagcccagacatcttaccccacctgaaagcttcccacagtggacaagagtccacagtccaagtgttgcgtggagtggaaggaagaaactgtcccattacttgttcaaatgctttataaaatcccaagactctatatgcataaggagatttttctgcctgtttggaagatggtcgaaaaaactgtcacatgtacaagcaaaatgcctctaaaaccccaattctgcttttactgtgtatattagggcaggctatctgttatgaaaaaaaaaaacaaaaaacttggtggtctaacacaaaagaagcctaggtctcactcaatcaagagtagagtgtggcattcagcagacgaccttcttcagagttcctcaggaatccaaccaggcgccttccatcttgtgactccaccatcgctaggtactcagagccctctgcagactctctgcatctgctagccaagggaggaggagaggatagactgcttggaaagatttttatgggccaggcctcgcagagccatattgcagtatcactagcattccattcatcccattggccagaactctgtcacatgcccacactcaaccacaaggcctgctgggaaatgtagtccagatggggatacccaggtggaaaaggaaacaagcttggccaaatatctctgccataatttataactttaaacaagtctcatttattacccacctttaaagcaaggaaatgaggcctgcttacatcatagacttgtgccaaggattaagagaaataatgtctgttgtggtgctctgaggcagtaaatacaggtgaactactattattattaatttcaccacctcctgaaatgtatgtactactatgtactgggcctggcccggggcccaatacatagtaggtgcaaaacaaaccattgtgcagttgatggtcttcccaccagcctcctgaatgcatgctttgctccagctagctggcatttggttcacacacacatctttttgacaagtcacccattgtcgtcagtcattgccgattgcccctgccagctatgagctggaacacaggaagggttttatctgaagcctgagacatcctgaaaggatgaagcctcccttcttgggtacctggaaggctgcccattgcacctcacattctttacagcctggaggccgatggtaaccatgagctctgtgaggggctacagcagccagctatggaggctgctgctgatgtgcgaagcgcatgcttgtggcctggagagctcaattcttttcccaagccccctccccctacccacaagctctagtgttgctcagaaggaggaggaaaaggccccagaacagttgtcaaaacttgatcgtcagtggtgtgcgcagttccctgtactatatataagtaggtgttttgaatgtttaagacatagaacttgttagatgggtattttttaaaaaaacgaatgtgtaaaacaaagatcacctcacaggtcataacagcttgcacttacataatgtttactatgtgccaggcatgttaattaatttagtcttcaaaacaaccctatgagatgaagagataattatagcaattttagggtagagaaaattggggcaccaaacattcactggtcttactcaaggtcagtcacaggagtgtacctttagtcagagcatggactctatagctcaccagagtccccaccactccctaatgtatcccagacataggggctgagcatcaattatcatttctctgtactcgaaaaacagtagagagcgtgttttttaagactgtgattctgaatccaaaccaccgtagtttaaattctggcactgtcacattttagccatgtaaactgggaaagttattaactgctctaaacctcagtgtcctcctcagtaaaatacatccaggaccaccaacttttttttttttttttgtctccaggggttatgcttaatgcagcatactgttttgcaaactctgacttgagacatattcagatcttctctatttgccaacagatgtggaaaaaggagctcagaaagttccagtaattttcccatggtcagtgacggtaccacatcttcagttagaacctagtcccatgaacctgcccacgagtcccatcctccttgcatttgcttgttttataaaagcctctattctcagaagctggtgtgaatgctttggagtgaacagctctaccatttattagcaaggtgatcataagcaaggtacaacctgggcctcaattttcccatctgaaaaataggctaataaaaaaccaatgaatttttcacaagattgcagagattgaatggagaaggtatttcaaatggcttcctctatcttcagaccttggaggtattggccagtcttgcctggaatacccatgttgccatcccagctccagaaaatatctttggcatggccaactcacacccatcttcctgattccttgttactgctcacttgtgcttagaaaccctcactgactacattctcccttgacccagaccagcctggaatttggggactgcatggattttaagctcatcatattgtttcaaattatttcagttgtttcatattgtcttgcttaagaatttatccccagaaccaagccctaggctcatgctaaataaatgtgtgttgggaacagccgccacctagggggctgcctggaaggtgcctccacttcctttccatggtgaggaattgggtgtagagttgggggtcttctggttccattctcatgtgcccaacaaagctgtgcagcctcccagatctcatagagaaatctttgagaccttggaatgggccctttccaagaggggctctgctctcctcagaagaacagagatgctgggaggcaggagctgggctgtcctccccttcagtagcttcagctccagccagcaaggctggcccagctcaaaccatgattggttgacatcgtaaggcagaaaggccatgtggcccttgggtttccaaatgcagcatctgcagctagactgcctggatttaaatactggcaggactgcttcccagttgtgtgccctcgggcaagttagtgacatctcactggtgccattttcctcatctgtaaaatgggaaccgacttcggagggttgtcctggggattaagaaactaaaacctgtaaaacatctacacgaggctatggtgcatattaggcacattgaaagtatttgataaatagaaagctaaatatgtgaagcaggatgcttggctgatcattatgagaggagctccaagacaagcaggatgactgtgagctgtgcagtgagggaagggttcaccaagataaggaattggacttgggcctgaaaggagggacaagattctctttagtggcaagaagtaagaagcactaacatttatgtagcatcaactaaaagccagacactgtactatatacttgctaattcagtgctcatgtcccagtgaggaaactgatgttcaggtggattaagtatcacccaacaacccagcctctaagaagcacaattaagatttgaactcagatctcactggctccaaagcctgttttccagcacttatctataccagaaatgtggcactttgtcacacgcaactgtgtattagtcaatgttcaagtacttgttactgtattaaaatgccaactcctattcataagcttttaagcatacaccatctgtgtgctcccagtacccagctagactgatcagcattaaagactgcaaattgcataattttgcatcaccacattttcctctccatatcctaacactcattcagcaaacatttatgagtgctacctgtatgctagatacatctattggatgctgttgctgcatcagtaaaccaaatatttccgctgccgtcatgtagctgatagtctaatggacaaggggcagatattgatcaaataattaaatgtgccatcttagaatataagtaggaaagtactaggcagtaagtcttcccagaaaaaaatgctaaataaatgtcaatttcctggctaggatggtgagataatgaccatagtatacatgtccaggtctttaaatcctcaggaagagaaaaatacaggcagtctgccaggtattccattgggaaactggggatgaagtgaggagtatatacagttcttggcctcatagagcttacagtctaatagggaagccgacatgtcacttagaacagtaaaactatcaaagtctatgcaaaaggctagttggtcaaaaaaggatgtctcttaaaatatagaaggcatggatttttgttgtttttgttgttcactgccaaatcccttagaagaacacctggcacagagtatttattcaataaatgtttattgaatgaacaaatgaccataacatttacaatgggttttaaaaaatgaacagaagtttgtcaggaaatttgcccggaactttgcagtgacccggatgtaagggattccttcagggctgaaaagatgaagaggatctgctgcttcagaacaaggatctgaaaagatggtgctgggctgagtggcaactcaagcccaatttcatttcagctctctcttgcctcaagtccatcttcatgagctgatctctgggtttcaccaggacagttccatgggagacagtactagaaggtcacgctctctcagaatattttagctaataaaggccccagaagtataccatctgacttccttgttttttttttttttttttttgagacggagtctcgctctgtcgcccaggccggactgcggactgcagtggcgcaatctcggctcaccgcaagctccgcctcccgggttcacgccattctcctgcctcagcctcccgagtagctgggactacaggcgcccgccaccgcgcccggctaattttttatatttttagtagagacggggtttcaccttgttagccaggatggtctcgatctcctgacctcatgatccacccgcctcggcctcccaaagtgctgggattacaggcgtgagccaccgcgcccggccgacttccttgttttaactgtaaaagaacgaaggctcaaaagagggaaattgacttgttcagggtttctggctagtgagtttcagggccaggacaagaacccagcattttaactccaggccttattatatgtggtgtttccaagctaatttaattttaagcagaataaccctttttcctaattaaattttaagtggatgaattcagaaatgctctagataaagccatatagaggccactggtgggcccataacctccatcatggaccaacccctcattccctgcacacacgctccttctttagggggaagttaaccttttctcagttgtatgaaagtctcacttgattaacgcctccgttccccagtcccactcctgcttacaaaaggatttcttctcctaaaccccatttcaaaaccactgcactgtagataatataagctaagttcttagcacagtgccctgtgtatagtaagtgctcaatatgtgttcattattgccattttcattgtgcactggctcagtccataggcatcagaaaagtggggaagggagctgccgtttgtgaaccacccgctaggattcaggcacagtacttgatgccgaccataacttaccttggttaatcttcctaatcaggtcaatctaccatctcatttttttcgttgttttgttttgttttgtttttgagacagagtctcactctgtcgccaagctggagtgcagtggcacaatctcagctcacagcaacctccgacttcctggttcaagcgattctcctgcctcagcctcctgagtagctgggattacaggcacacgccaccacatccagctaattttttgtatttttagtagagatggggtttcaccatgttggctaggatggtctcggtctcctgacctcgtgatccacccgcctcggcctcccaaagtgttgggattacaggcgtgagccaccgcgcccagcccaccatctcattttatagctgaggacatggaaactcagagaggtcagctacttgcctacagtcacacaggtcataaggactaagttaggacaccagcccatttctcaatggtccaaattcctccctccccaagacatgcacacacatgcatatatgtatatagggattccactgttttttctatcagactggctatctttgtttcattcaatcctgacaacagtgccatttcttcatttgatgaatatttaggagcacctatgtgtcaagccctctactaagccttgggagctggaagtaaatgggcacagtgccttgctgcagatgtatgcagataggtggacaacagatgagtagctacaagtgtgatgtgattaccaacgggagaaaggagagtgaactctgggcacatgtaatcatcccccttacatagacaaggaaactggggttcagatacgttaaagacttgcttaagcctgggcaacatagtgaaaccccgtctctacaaaaaataaaaacaatagctggggccgggcgcagtggctcagcctgtaatcccagcactttgggaggccaaggctggcagatcatgaggtcaggagttcgagacccgcctgaccaacatggtgaaactccgtctctactaaaaatacaaaaattagccggatgtggtgacgcacacctgtaatctcagctactctggaagctgaggcaggagaatcgcttgaagccgggaggtggaggttgcagtgagccaagattgcaccattgcactccagcctgggcaacaagagcgaaactctgtctcaaaaacaaacaaacaaacaaaaaacaatagctgagtgtggtggcccatgcctgtagtcctagctacttgggaggctgaggtgggaggatcacttgagcccaggagttcaaggctgcagcaagctgtgatcgcaccactgcactccagcctgggtaacacagcaagaccctgtccctaaaataaaaaaatatatataaaaagacttgctcaaaaatcacaaaacaaataaaatagctaaaattcatcatgcgctcactacatgccaggcatttttttctttaactcacttaaatcctcttaacaactctgtgaggtaagcgctattatgatcttcattttccacaaggaatctgagtcacagaccatgaaagtaacttgcctgaggtgataaagctaagaagtggctgagtcaggatctgaacctagatcatctagctatagaccctgtgttcttaaccctctgaatccaggtctgactccacggctgccttctctgcaggatgggaggccggcggggaagcagatttacagtgcctgcccattgggcatcctgggaaccccctctgtgtgtaacagtgattgtcatgactgagaatctgcttcaggaaggcaaggacccagttcccaggcagggatgagctgcacgcagcatccaagagagcagcccagctcttaaagcacctccttggatgtgtggggctccctaagtgtgggccttagctctcaggagattagagagagagtcatgcttccagaatctgagacttcctagaagaaaacaacaggtctgccggcactcttatcttacacccatgggcgccgggtccaggtactcacattctagagaggcctcaggtgctcagcggtagggcaggtggctggggtggagtcaggagcaggtccttcacaacctacttggccccaggggacggtaactttagagactcaaagggagccagaaagagtcctctatgtaagagttcctgcagctcaaggcctcagagagagagacgtaggttaaagtccttttctggagaccagggtggggacaggggcataggttaccaaacatcactggggaatacgtgacttctaagccaccacttggtgaatgtcttgcattttttggagttgtttaagaaaagttagagactgtgttcacttgtatcatctcaggtaagcctcaccataagcccatggcctttcaactgtaaaaggagaattacacacatcttcgaacaaggtgacagccaaaatgagatcacatatggaaaaaatttcacgtttaccctttcttcacaaagttgttagatttcatgaaaatgctttaaaagctataaaacactatgaaatgttatcttttcctattttatttggttctaattaatttcaaattctgaggctagcctcaaaatgcctactttctttgactaacatattattatagttttatcatctgcctatttatctaagtcttctctggaggcagttaagtttttagcctttatgtcttatgataatgagctgctaagtttaccttatttatttttatattttgagacagagtcttactctgttgcccaggctggagtgcagtggcgcaacctcaactcactgcagcctctgccacctgggttcaagtgattctcctgcctcagcctcccgagtagctgggactacagcgcatgccaccatgcccagctaatttttgtattttttcagtagagtcggggtttcaccatgttggccaggctgctctcgaactgctgacctcatgtgatcctcccacccagcatcccaaagtgctgggattacaggctaagtttactttagaatttaagaagttaaatgattctgttttcaattatacatgtatatctttatagtttcaatatcatatttatatgtgtgtgtatatttcttgacttgaaagctagactctaaactcccagaaggcttgacctatgtctagttcttagctataattagcatttattgagcatttttctatgtgctgagcactattctaagggccttacgtggattaactaattcaatcttcccaacaaccctattaatattaatagtactagtatgacccttcttatacacagagaggttaaataacaggctgggttggtgaacctgggcttctaagccgagcagcctagccccagagttcctactcttaagctctactctgctggctccctttgaacccctcactcagagccgtgcatctaagagacacttggaaatgtttgtcggtttcatttaaggccattgtgtaacccgagaaataaggcttagagatgggagataattgcatgcgtcaggaatgcttttagctgcaagtaacagaaaacctgacatgtagaggcataggcaataaagacatttctttttctcacatagcaagagtctaggtgtttccagatttggtgcaatgagaggtttgctgtcaaggatcaggtcactctttgccattctttcctgtcattcttagattattggcattttgttatcatgctcaatactatactgtctgtattagtctgagttcttcagagaaacagaaccaatagtagatgatagataaatagatagatagatgtacatgcaagtatagctacagatttactataaggaattggctcactggattatggaatctgagaattccaggatctgctgttggcaagctggtgacccaggagagccaatggtgtgagtcccagtctaagtccagagtcaggaggagactgatgtcctagttttcaacacacctgctaataaaaattattaattactcattcactgatttcccacactatctaacatttccatatgatgaaacttcggctcactccttggtgcctgcctaatccttcagatcattacaggattattcttagccatgcactacacatcagacacttcaactgccttctcttcagtcactcatatcagctgagatgtaaactacggctgaatggtccgctattttcatgctaacgatgcttcaatatttttcatctgcctcttcttacatgttggtggaggtttatactatggatcatttacatttctagaaacctgaaatattggcattatcctcctactcacaactcctacttcaacaggcaggcagggagagcgaattctcccttactcagctttttattctatgcaggcctccagcagatctgatgaagcccacccacaatggctcaggcaacctgtgttactcagtctatagatccaaatgcaaatctcatccagaaacacccttacagtcatacccagaataacgtttaatcagatgtttaaacacctgtagcccagtcaagttgacacataagatgaaccatcttgctgtcccaacttgactgccacaggtggaggcatcatgtcaatgtcaggtcaggatgacggggtcgtgcctggtggctcttctcctctcaggcctcctcctttaagacactttgccagaagtccttagcagatttctgtgttggcctcattgaccagaattgggtcacgtgtcactagcactagctacaagggagcctggcaagattgaatatctggatttccaccctctgcaatagaaagagacaaaagagaggaaggttgtagttgttgggttagccaacccacagcatttatcagagcagcctgtgcaaagtcacagaatcagtagtaggaacagaattaggacccttgactgttttcttcttctataatatgtaaaagagaaggacattttattctctaggctacaatttggtgactgaagcctttactccacagttctccaatttctgtttcttagcagtgattcaccaggcccttgctctcagtttattgcgtagaagacataagtattacaaggtgaagactttcagaggataaatgacacacaagtaggccagtaacagggtcccaggatcttgtctaccctagaacaagactcgatccagttggaccaatgcttattgagtgtccactgtctgattgtcatagtataggctgtgataacattgcaagaaagaaggtaccatcatctgtgctcttgatgagctcacagcttggtggaaaaccaagttgtgaaacaaatgtgcactgttgaaggactgagggccatgagagaggaatgtatgtgatacagtgaagcccagcaagggacaggccagctcactgccatgttcaaagaaggctttctttgcgaagaaggggatattgaagccaactggaaggatgagtgggtattttccaagcagacaaaatagaggagggcattctattccaaaggaatagcatatacagcatgtggaggtgtggaccagttgggtttgctcaggtcttaccagactctggagtgaaaatgctccttccccacacgtggacagtcactcagctacaaagtgcttatgcaagtgttctcttattggagttccttaattcctaatctccacttactgccaaactctactgatttttaagactctactgaagggttgactcctgcaggagacaatatcctgggcccctgttactgtgtcaactgacaaaggctcctttctctgttcctgtggtgtcctcaccattttccttaccatgttggcaatgtctctgtctatgtgagtctcttccagggctccatgagctccgtgacagcaaagaatgtgtctcatgcatctccacagcccagtgcctacggcagtgccaggtatccaattaatcccaatgtatagttgaggaatggagtgaatggataagtcctgggaggggggcagagcaaacattgattattctcatacgcaaatggaggaagtgcagatgaagaagggtcagagtgttgggcccctggtcataaaagtgagagcgagactagaacccaggcaagctgaccctgattcagattctttctattctaccatgttgcctccagaggaagcagggcccatctttttaattttatagggtccagaaatagattccagactatcagaattcttgggcatttcctggtttcttcttctcccaagcttctctttatggtcctgattctcatattctctaagcttctcctctctttttcccttaaattcacttctctaagtttttacaattcactcattcacctagcctaccccagaaataggtagcttcccccagataatctccaggcttcagcaaactggcattcatgcagcctccctgataacccagggacaaagaactcttcatcctctcccttgctaagacctacagcagaagactggagatgggagatgggtgggaggtgattctggggctgtgggtggctgtggtatccagtttatatgtccacctagcagaattgaattcctagatcacctctttaaaatagatctctccaatactatactttcaaggatcagaaatacatctctctctcccatgctggtaccagtgtctggtttttactacttagagtctcgtttccttcacagcactcatcacaatttgtaatagcatgtatgtgtttacataggttttgggttttgtctgttcccacactatcctacaaaaccaaggatcacgtctatcccattaacctctgtatcctcagctcccagcacactgcctagaataggtgcagagcgtgtatttgttgaataagacaatgactgtgcacagggtggcttttttattttttatttttattttttgagatggagtctcactctgttgctcaggctggagtgcagtggcgtgatctcagctcactgcaacctcagcctcccgggttcaagcacttctcctgcctcagccacctgagtagctgggattacaggcgtgtgccaccatgcctggctaattttttgtattattttattagagatggggtttcaccattctggccaggctggttttgaactcctgacctcatgatccgcccgcctcggtctcccaaagtgctaggattacaggtatgagctatgcgcccagccagctttttattattattattattattattattattagctaaaaaggaatcttgaaacaatacctggtctccaaataataccttttatatagacctggaatttacttccaattgtctgatttcctctggtcctcacagcagttctgtgaggaaggtattaaggttcctagtattaaggaaggaagctgaggctcagagggcttagtagctttcttagagtcacattaagacaggaaaagggggctgaatgagttatacggaagtatgtattgagcacctgctgcctgccttggtgtgcgtggccctgaaaacaggtccgtatattaggcattgccatcgctatggtgtaatttttacagataagcaaactgaggcacagtttaagcaccttgcttaagcaggaatggctggtccaggatatgaaccgaagtcggatggcaagctcattggtttccactattatcatttgcaaagaaatctggatgtgaagaattctataaatcctcagagaatgctgagcgctcttcagacctccttacagagaagagggaatcactcagtggctggagtgggatgtgggaagacctgggaaagtacaaagaagtgacaggattcagaagccatgggaagtatcagaaaaatccatcagggctcagcacaagcaacagaaagtgttgtagggattttatgcagaaaggtgcttaagacgtggctttaggtttcgagaatgtcatcaaaaggactggagaagtggcctccaggaagcttctgagccctgcaaaattgacccccccagatggccaacgtgtcaattcaagagccctctgccatagctgggattcagaaagcaaagtctggaagctgctgccacctcagctcctcgttggtacctaagaaactggagcagggccctggacagaaatcacaatcccatgcagttaggtcttcaggaacttgtctgcatgcagggaacagccaaagaggtgggaggtgattgtggtctcagttctgcctcccagagtccagcaagtgcttccagttggctgaatctggtattgttaggctcccagctgcaagggggtctaggaaatgaagtttttaccattgcatcctttgcagtccaagaggacacgctagtagggaggtgcagtgccagccaaatgagcatccatcccaggagacacaagggaagctctctctctctctatatatatagttattataaatcaatgaagatggatattctaatctaaaaataagcagtagatataaacaggcaacttgcccaaaagaagaagtggcgtgtgaaaaaacaggttaaaaatgtgctaaatcggccgggcgcggtggctcacacctgtaatcccagcactttgggaggccgaggcgggcagatcacgaggtcaggagatcaagaccatcctggctaacacggtgaaaccctgtctctactaaaaatacaaaaacttagccaggcgtggtggcatgcgcctgtagtcccagctacttgggaggctgaggcaggagaatggtgtgaacccgggaggcggagcttgcaatgagccaagatcatgccactgcactccagccttggtgacagagcgagactctgtctcaaataaaaaaaaggtgctaaatcaggccaggcacagtggctcaaacctgtaaccccagcatttggggaggctatggtgggaggactgcttgagcccaggagtttgagaccagcctgggcagcatgggaaaatgctctataaaagatacacaaattagccaggaaaggtagcacacacctgtagtcccagctgcttgggaggccgaggtgagaggattgcttgagcctggaaggttgagtctgtagtgagctatattttttccactgtactccagctttggcaacagagtaataaccctgtctcaaaaaaaaaaaaaaaaaaaaaaagcagctaaatctcaataattacccaagaacaaatggaggaaaccacgaaatttttttttaggataaaaaaaaattaaagatcaatttaatgttgctcagagtaggtgaaactggccatctagtaaagtattgataaacatggaaattaatacaaatattctgagagaacaacatacctttatacattcaaagcctttgattcagtaagtaaattccctactaatgacttttgataaaaagttaggaaaatccaaaaagatataaaggcattttccccagaagtctttgtaatatattttttaaaatctaaatgcccaacaactgtgaaatactagatactcaataaaaagatctaaaagtttatattttggcatgcaaagatccctggatacagtcagttttaaaaagattacagaatggcatatatgtataattctattttatttacaaatatatgcgttgatttgtttacatactgaaaatatgagagggaacacattgacgtgtaaacattatctttacatcctgggactactgcgtttatcctcttctttataccttgctgtgctatttgattttattttctttaaataagcacatgtcacatttattaacagaaaaattcctataaaaggttttttgttttttttttttccttgtggaggaaaacttgggccctgagaagctcattctacccttaccccattccggaagctttagaaagcaaacccttccaaagcccccctgaagcaagagtgtttagaacccaggaatggagctgggggcaaaggtgagtaattatagttggggcaagaggagtggtgaggagggagatgagctaattttagccttcctgatagagagttattccaagatccctacactccttttgcacatgtttagctctgtcctgcggcctccaccccagtgactgcagggctgacacaggcactaatagacttcagattgtaacaaaatgcttgagatctctgctgctttaaatagaggtgtttggcacctttgggatgccatgtctggcaaagttgggctcctcagcactcaccctactttgaggcccagtgatgagaccgattagagggccagctttcccttcaacctcaatgtggctaaggcagaactcatcatcccttaaactgggcaatagagatcaagtatccctcatctgaaatgcttgagaccagaagggtttttgatttcagattttggaatatttgcattatccttagcagttgagcaaccctaatgaaaaaaatccagaatgctccagtgaccatttccattgagtgtcatgtcagtgctccaaaagttttgaattttggagcatttcagatttcaggttttcagatttgagatgcatgacctgtacctcctgcccatgaagtcttccatctcaaatcctgggggcgtcttgcattcctgcttcacctcctctgttatttaacctttttcttccttctccttctcctctgttaaacatcactgatcatcaggaaaatgaaaatacaaattataatgagatgtcaaattaaaaagactgacagtcgaatctgtcagcgaggctgtagagtaactgtaaccctcctacattgctgttggggatgtaacgtggtacagcccctttggaaaatagtttggcagtttcttataaagttacatatataggcactatatgatccaatcattcccctgctagacttttccccaagagaacatgagttagaacagattcttaaagcatactgtgtgggccctttatggaatcatataactttatctctaagtgaccttaaaaataataacatctagaataatagttatatcttatttagtgtctactaaatgccagtcatgttacatacatatgctttcctaaaacatccctagggatggtaatatcttgagactcaaatagccactcgacagaagcagatatccaaaaatagccaacaagcatgtgaaatgatattaaacatcattaatcatcagggaaataaaaataaaaactataatgaggtattgaattaaaaagactgacagtacaaactgtcgttgaggctgtggaataactaactttcctacattgctggtggggatgtgacgtggtgcagcctctttggaaaatagtttggcagttccttataaagttaaatatataggcaccgtatgagccaaccattctcctctagacctttccccaagaaaaatgaaatatgttatctaaatgacttttataagaatcttcatagcaactttattcatcatagccccaatctggagacaacccaaatgcctgtcaactcgtgaacaataaacaaaatgtggtacatgcacataagggaatgcttcttggggataaaagggaacaaactactaagagatgtatattagttgtctacaaacttatcagcttcaaacaacacatatttattatctcacagtttgtgggggccaggggctgggcatggcttagctgagtcttctgtaagactgacatcaagattgtcatctggggctcagttcttatctggaagctcaactggcaatggaaccacttccaagctcgcttgggttgttggcacaagtcatttttcttgtgactgtgagattaagggccttggcttcttgctggttatcagcgggaagttgcacacagttcttttttttttttcttttctgagacacggtctcgctgttgcctaggctgaagtgcagtggagtgatcatagcttgcagcagcctcaaactcttgggctcaagtgatcctcccacctcagcctcccaagtagctgggactacagatgtgcatcaccatgcccggataatattgtttatttttggtagagatgaggtctcactatgttgcccaggctggtcttgaactcctgaactcaagcgatcctcccaccttgacctcccaaagtactgggattacaagcatgagtcatgtgggcctttccatgggtctttctataacatggcagcttgttacttcaaagcaagggagaacaagaatacatctgggagcaagactgagacttatctgacgtagcattatcatggggtgccaacccatctcctttgccgtattcagcaaaccagtcacagatcccaccccctccgggggagaagcatgtaagggcttgaacatgagaggcagggtcctgcgggctgccttccagtccatacttggcagcacgtaactatgcagacaaatctcaaagccattatgttgaggaaaaaaagactagagacaaaagagtacacatttcatgattccactgacatgaaattctagaacaggcaaaactaatccatagtcactgaaacatcagtggttgcccagggccaagggaataaggggcaggggattgacagtagagggacacaagtcacctgtgaaggtgatgaaagtatatcttttatttggcatgatgattatattagtgttacatatgtcgaagcaaatcaaactacgtttcaaatgggtgcattttattttatgcaaatcatgcctttataaagtatatatttttaaatggctctatgaattgcacatttttatcccctttttaccgatgaggaaactgaagctcaaaacgtgtccagagtcgcacagctgggggagccgggatcctaagccaggtctaactgcaaagccccttctcttttcctttatgcatgacccctaattctcctcgaagctgccattttcacagggagaaacgcaaggcttggagagctagagaaacattctcacgacctcgcagaagtgactgagttctcaagcttatgtgttctgattccaggtcaaggggttgccagacctcattaaagtcttgtagcagattttaagagttactattgcatttttaaaatttacccatgtgtgtcattgtaaacacacttagcaatattgttctttaaaacacacaagcttatgagccagttctttacaagaacaacatatggctgtccatgaaaataaaggtttcggaaggtgtgctgtctactgttggttgcccgccttctttcatgcttgccaaatcctgagtttattcagctgtttggtggccatgtgcttcaaggaaacataggcccctttctggtgccatgaggtgaatcctggttcgtttcagccagctgtggtcattctgttcccactgggaaaggtgtttagaaaagggaatatgggcctggtgcagtggctcatgcctgtaatcccagcactttgggaggcagaggtgggcggatcaccttaagtcaggagttccagaccagcccagccaacatggtgaaaccccatctctactaagaatacaaaaattagctgggcatggtggtgggcgcctgtagtcccagctactcgggaggctgaggcaggagaatcgattgaacccaggaggtggagattgtggtgagctgagatcgtgccactgcattccagcctgggcaacagagcgagactctatctcaaaaaaaaaaaggaaagggaagatgatgcagttctgaccagggaggcctgagatgtacctgccgggaggattctggaacatccaccatgcttcttaaaagcgacacaagaaagagactctttttcataggcatgagggtatggcccggggcaccagggtggctcactgataacgtgaaggaacagtatgagaacaaaagtccatccttgagaacaagagtcagaaggacacaaaacatttagatccttgagtctgacattgagcctctgatttactcggccctgtgattgccctagctcagtgatatgagctcatgcattttctttattgatttagtcatcactgttatttgcagccaaaatcatcttcatattcagaagatataagcagatactgtcaaaagtcttttttttttttgcacccaactccatggtgcataaaattcttatgaatgcttttatacatgacattccattcaaaattagtggcaggcaattgaaattatacactatgtaagtgttaagattagtttcattctcggaagtgtttgttaatagctaaagcttagaaacaacctaactgtccatctgtagggaactggttaaataaattacggtcgagccacataatgagatacaattataaataaagaagcatctccatttgtactgatatgaaatgattttcttttcttttcttttttttgagacagtctcgctctgtcgccaggctggagtgcagtggcgtgatcttggctcactgcaacttccgactccctggttcaagctattctcctgcctcagcctcttgagtagctgaaattacaggcacgtgccaccacacccagctaatttttgtatttttagtaaagacaggatttcaccatgttggccaggatggtctgtctcctgacctcgtgatccgcccgccttggcctaccaaagttctgggggttacaggagtgagccaccgcacccggccacgaaatgattttgaagatatgctactttgaagaaaaacaagttagaacagtatacaggagactttgaaatccaaggtcatagaaaaacatctgaagtttattgcctcaattctttatgtggattggcttatgtgatcctcttagcaacactctgaagtacatgttattgttaccattctctttttgaaagatgggtaaactgaggcatggaactgttaactagtgttcctgggatcccacagttgtttagtggtagaactggggcttgaacccaaagtctgtgctctaaacatgcaatcaattgacccctggggctattggaagaattaaatgagctcttgtgtgcttagccagtgttggccttaaccagtagttctcaaagggtagttcatgctccagcagttttagaaatttgttaggtgtgtatttgttgggaaatgtgttagcttagaaacgtttcccaggttcggccagactttgttttacatggtagctgcatgctgacgtgtttcttggctggtatgagtatatgaagtcccacctagcaggggaaagaataagtcccagctagaacttgaggaaacatacctaagtgttgttaccaccttgctttcttgtccagcagccattgattggccaccactatggactcagcaggaaattatactgtaatcagtgatgtctgatgtgggcttaggagataccaagattctactaccactctgaggccggctgttggatctgtacacaccaaaacttgccaacttattcccctcatcaaacttagctacgccataggacaggaatctcaaaccctttccttccttggtgcatttcacataatagatgctcagtaaatgtgcactgaatggagatatcatcacagttcacctggtagcagctatctttttttaaaaaagagaacctaacaggagttctcagccttggctgcacattccaattacttagaaagcttctaaaaatctccaaacccaggtgggcacttcaggtcaattctatcagaatatctaggggcagagaagaggaggaagaactagttttgagagctccttgggtgattccaatgtacagccaagattggcgagccactaaactagaatgaggagggttgatctgacagctgccaaaccagtaaacacacacagccccagacacagtgggtaaaacccagagggctttctagaaagctgctcctaccctctgcttcttttgatgggcatccgactgagctggaagccatcaagatcctgtcttaagaggttcccagtttcctgtccacagtggagggtgcagctggaagcatttatgctggaagcccttactgggttatggtcctaaaaattactgccatatgtctccagcagggagggcagggtccacatttgttccctgcaccctctgcagcctctttatgtagctgctcaatactcacccatgggggccccctaaatagctccctttagtttcataattttattgagcttctagattccttgcaattggccagaccctggaaattcagatataaattcaacatcaccactcgctggtggagttcacagcctggagggggaaatgggaagtaaatcaactgctaggatgtgacacagtcagggcctggtggagaatagttcagagaagcaagggcttagaggagctggttggggggcggggggacttcagaagccttctgaggagaagtggtaatagcgctgaggcttttttattgttttctttttaaatattcatatacatattgcaaagttcggaataatcttacacatagatagttgaacacactactttgacaaatattaacattttgccatgtttgcttcagatcctaaaaaaaaaaaaaattctgaactattttaaggctagaaaaagtacagagaataatttagcaaacactcataaactaaggtggttaagacacccgctctggagccaggctacttgcatctgccgtgtgacattggagaggctgcttgtcctctctgtgcctctgtctcgtttaaacacacacttcaaagggcaactgtcaggatcaattaaggtaatactctgaaaaatacaagttcccagcactcttaaatgctaactgttgtttcccttatgttcacaactgagtttgtcaaatcttaacatttagccgaatttgttttagattttttttaatgaaaagaaatataataccataggtacttttaaggactcctgtctacacccttccctgcactgatgacagacaaaatgttagccaggcggtcagagtgggaaagtccatgttagaacatagggacagggaaggccctggcttctgaggaaaccctctgatgtggtcagaaaggaagatgacctgaccgatgggcaggggaggaggctggagaggcagccgcagcttgtcagggaagaccatcaggcgtttcacctgacagcccaggtcccgtcacagacagacgtcacatcctgccctcccctgtctcccaggaaaccctcgaggttcctttttttttttttttgagacagagtctcgctctgtcgccaggctggagtgcagtggcatgatctcggctcactgcagcctctgcctcttaggttcaagtgattcccctgcctcagtctccgaatagctgggactacaggcacatgccaccatgcccagctaatttttgtatttttagtagagacggggtttcaccatattggccaggctggtctcgaactcctgacctcaggtgatctgccctactcggcctcccaaaatgctgggattacaggcgtgagccactgtgcccggcctcaaggttcctttttcacatctttcctttaaaaaaaaacaactatcaaacaatggataaaataaagaaagctcacccactcttgcccctcaacctggaaaattccatcctgtgtcagctagctttgagggaagatggagaacctagggaaccagcgagaagtggctgggccacctgagatcagcgccacctgggtgctctgggggcggagatgggtgatttagggctgtggcccaggcaggagcgtttagcatcttttgggcccagcttctcagtcttgcactgaggaagcagcttgggagggggtgccctaccaggcagatatttcctgctgagcgagctgataagtgagccctctgactagttcaatagttaacccgacagagcacagatgtggcctgtcagacagagatatgtgtggggaaggccttgggtataagtacatattagcgcctggcctgggtttgaaatgtgctctcccatcacccctcggcagtaccatcatttttcatctcaaaatgggctttccccttcccccactcctctctcctccactccactgccccagcatccgttccagccgctgccgaggaacagctgctctgaggcccatctctcatcagctgccttatctctccgatgaataatgttccccttccccgagcagcagcctggcaggaggcccgccccagcgctgagcaggctgctgacagcgctggagctcaggcagctgtcggagagcagggctgccccaggccaccacgtgggtgagggctaacccctctgcctcccggcgacatgccacttgaggccccattgccctggcgagctgcagctcacaaactcagcctttccaagcacatctcagcagcccctgggtgcaattgccatgctgggtgctggggaaacaggcatttcagacatgggccctgtccttcagtggcgagggctgtttacgagacgcgcaacttgtacctaacagttcagacctctgtatttagtagttcttaggaacatattaactactccaggtttcagttatcctcatctgcaaaatgggctagtaatagtggagtgtaaatgctggtcagttctctgctcacatcctctttgccagccagtgcccccagcggctccaggtgtcatggtaatgctgtacccgtggccttctccatttcttgggctgatggtaactgcatccctgagacggctgagagggtaaaccctctccaccaccacccaccagggggtcagtgactgattgctcttggggatacagaagcccagcgctctttcctcaaagtgggacaactccatggcactgtttttgccccagagcccccctgtagaccaggccaaggccagagcttctctaagacaatatccctccttggcttcttccccttccttgagctaccaccgtcacccctcacagttttcctgaagaggactccctccatgagtcactggcttgcaaatccctactttagcctccacttctagggaacccagcccaagagaagtagctactttacaggggtttggggtgaggatgctatgagatcatgttgaaatgccttttgcaagcatctggcactcagcaagtacccaataatgagtaatcgtgattcttacaaaccagtaacacctgacagaatgtaacaggggagctcagatgcacagctacagtgggaggtgggagtcaaaaaccttggcttcaagttctggcatgggagacaatcatcccaggaaggtcccccaggggtcacatagcccaactctcctttgaccaatcgggaacctgaagctgagagaggagaagcaacaatctcaaagacacaagagcagagctgggactagaagatgtcttgatttttcccaccactcctcattattttaaccactttctgatcctctgttttcagttatttttttaaaagggttgttgactttatatggaccaggactctgagaagagaagccatttccatgtggatcccttgagtacctactatgtgcttaacaccggctaggtactcagggaaggggtcacaaaagtatattcctatccttactgctgtggtctgaatgcctgtgttcctcagagttcaaatgttgaaatcctaaccttcaatgtgatggtattaggagatgaagtctttgggaagtgattagccatgagggcagagttttcatggatgggattaatgcccttataagtaagaggccccgagagagctcccttcccccttcgactatgtgaggacgcaatgagaatgtgccatctacaaaccagaaagcaggtcccccacctccccagcatcacatcagctgatgccttggtcctggacttcttagcctccagaaatgtgagaaataaatttttgttgtttttaagccactcagtttatggcattttgctgtagcaactccaagtctgtctctccaggatctataaatgtgcctggcacatattagtgctcaatacatttttgttaaataaatggaataattaattaatcagtccgtgtcttggcagatccatgaaactttacctccctgggtagaaaatctgtttaagggtatgtgatgctcaggcagatcttaaagagactgcagctgcagagtttctagacacttagagattgcagaacactttactgttttcaaagactgttttcaaagtgtgtgtgtgtgtgtatgtgtgtgtctgtgtgtgtgttggttacctttattttttttaaccagtcagtatagtgattttcaaaaattttttaagtgcattgtcaacatttaagtaattgagaatttcacataaatacccagatttaggtatcttttgaaaagtcacaagggccatgcaggaccctcattcccacatggccataatggcttagaccttagactgggccccatttgcttattcctcactcctggtttctccctcctcatcctccacagaggcttccattagctgccctttgtcttagtggttgtgccctcctacagaaaagtgaaatatacttcatactattgagtgacaaaatgaaagatatgtgaaaggacatgcctgcttccaaaaaaggttgaagagagcattgtggaaatgaaggatattcttatgtgctttatatgaaaacagagagtgtgtgtgagaagagaaaaccgaagaggcccacctcactcaaccatggtggtacctgcttggccccctggggtagtggcagggaaatcacataacactcaacactcagaagtatggaccctggactaggctggggctacagagaggaataagatgaaggacttgtgttgaggatttagaagctgaaggtctgttaaggtgtctcaagcatgaggcattggaggagaaaaccagagtggaaatgaggagtggagagtgtagggaccaatcctagacacttctggagggaagacttagcagctctggtggctccatacttaaggaatgtcagggagaagaactgcacatgacttcagggtgacatacgcccagttcctgggagcacgacagacctttaacagaagtcctcagatccactttgggggaagctgatgacttggggtccagtcacattgagttggaggtgatgatgagaggttcagggtggtggaaggttctggttgcacggtgattgtgcacacggacttcgaagcccaaagacctgcactccagtcccaggtggacaccttcttggctgtgcttcatctctctatgcctttgtttcttgaaaaataaagctattattatcgtatctaccttgtagagttatcatgaggataaagataacataagtaaaatcctaaaaattattcctggcaccaaggaagtgctctataaatctgaatcactttcattattgcctatgaggacaaggtaagggaagtccctgaatggagatgattccatgaagcagagaaccaaagattgagccttggaggagctcttctcttggagaagagctgtagttagggagaaaacagtgaaggagctgggagttgggaagcaagggcggagggtgtcttcgaggcaaggtggaaagggtttgcggagaagggggacagtgatcatgccacagaagccacagaggacaagaggagccctgcagcagggcttctctagcagggtgcatttccacccaggggacacttggcaatggtgggagacattgcttgttgtcacaactgggcatgggagtgctgctgcgtctagtgggtagaggccagagatgctcctaatatcctacaaggcacagaacagccccccacaacagagaattatccagcctgaaaatgtccacagtgctgaggttgggaaaccctattctagagccaacaggctgtgaagcttgactcatggttccatcaccaatagctgcgtgaccttggtgagttccttagctgctctgtgcctcggattcatggtaggttttccttgttaggtttaaatgagtgaagttatacagagggcctgaagtctcatggtattttactagagcctcattgtgttttagttataattagaaattgggtaaggtaaggacacagaagaagccatctgatctgggggcttcacacttagaagtgacctcggagcaattgtattggggtggaaagggactaacagccaggagcagagggcacattggaattggggccagagggcacagactgccttgtccatcaggcatagcaatggacagaggaaggggaatgactagttatggctgcaaggccaagtacaggggacttatttctcatatctatctatctatctacctaccgtctatttatctatcatctatctacttatttatctatctatttatgcatgtgtaccaaccgaaagttttagtaaatgcacaaactgcgatataatgaaaatggaaattttcaaaagaagagaaatcacctgccacctgactaccttaacaaatgagtggttttcatctctccttccaggcctgtcatttttacagtgctttagtcataaaacaggtcctctattctattgttttatgtcacatgaaattgtaccataagcattttccatgatgtgactccactgtttcattttccatttttttccagaatgaagataacctcattgtttttttcctgattgtaaaaatgctctgtgctctttttttttttttttaacaatgcaggcagtaccaaaaagtatgaagaagaatgtaatagttcccatttcccatctcactctttaaggccagcattttggtgaacatccatccgaacaaatctccacgcgtttatcaatttgttgacttactccttcttttatgtaaatatgaacatgatttaactgccagtccatttggaaccttaaagtgaaggttttttattgttggggtttgctatggtctgaatatgtgtgtccccccaaaatttatgttgaatcctaacgcccaatgcgattaggaggtggggccattaggaggtgattaagtcatgaagtcatcagccctaatgaatgggatttgtggccttgaaaagggaccccagagagctgccttgccccttctgccatgtaaggacacagtgaggagctaggaagggggcctcagcagagaccaaatgtgatggtgcctcgatattggacttcccagcctccagaatgtgagaaatgaatttctgttgtttataagtcacccagtctatagtattttgttctagcagcccaaacagactaagtcagggttgttgttttaggaagtggggaatggggccatgcatgggtgtacgccagaacaaaggaagccagcaagtcctgaaagatactggaaaagggaatagtgggcacgtgcagtgtgttagtttcctgaggctgctataacaaagcaccacaggttgggtggcttaaataacagaaattcattctcccatcattctggggaccagacgtctgaaatcaagactcctatgccatgctccttctgaaggctccaggggaggatccttccttgccactctctagttcctgaaggtcaccagcaatccttgaaattccctgtattatagacacatcactccaatctctgactccctcatcacatggcattctcttcccctgtgtgtgtctgtttccgaatttccctcttctcctaaagacatcagtcattgggttagggttcactctcctccagtgtgacctcatcttaacttgattatatttgcaaaggccctattttccaaataaggtcacagtcacaggtaccagtgcttaggacctcgacatatcttcctgggggcaacagttcaacccataacatgtggggttcccagggtgaccaggaggaagaggatagagcaaggacagagattcaggaaggaagagaccggaataaagataccaggattgtgaggctgaaacgagacaaggaagcttccttcctccagcaactcgtgtctgtgttttattaacctcctagcactttacaaagagggccctcggattcaacagagagccgggctgtctgtaaaccccaccgggccccttctccaccggtgtgcatctggcagctgccatgggggccccacaggcctccctcctgcatcctgttgtctgctcctcaccagattcttggttggctgccacctaatttctttttggcctgggctaatttcttgcagtcctcgggctggcgggaagcatcactaattcccaaagtccttccatatgggcgattcaaacccctccatctgcaaagcgtgcacatttccttggctttatccttgcagaatagtggtaccctaagtctgcaggagcatggagcttgtttcaatgttttgaattccccctccccatttgctggtttactcggttccctttgtccccttcccccagatttgatacccaaggttgaattttccaaggtggagtgttatgaagagtgtggagacaattaagagaaaacgtgaagtctctttgcccgttgacatggacgtcagaaagtctggagccttcgcaggcctggctggaatcagctctgggtgtgatgggtctcagcatgtgaacaaaatcagcatgaacatcaccctttgccaacctggctcttggggaccaggggacagttatgaaatagtggtcaagtgactgagaataatgaggcttctgctgattaacttaggtcccaggcaaagtccagccaagagctgttcttgccaccacagacctctgcatatttgagagaattattacacttctccaatggttaagagtcacttcacctctggcctccagctttttgacgctgccagaagcattcagtaatccccctgtgacacgtcacctgtcccatctttaccgttaattatttcttgtccttgatttcctctcaagtgccaacagccacttctgagaaagacttgggatcaggagcccaaatattatagctcatattacggttaaaggtgaaataacaagaaaacccagctacaacctgcggccaggacgtgccagtttgtgtgagattaaaggagaccttacccaggcacgagagacccaggtcttgggctcagtggggctctacggcaggaagagaaggaaggggcttaaaaggttgggggatttttctttttactttctttttcttttttgagacagattcttgttctgtcatccaggcagtagggcagtgacacgatctcggctcactgcaacctctgcctccctggttcaagcaattcttgtgccctagccttccaagtagctgggattacaggtgtgtgccactatgcccagctaattttttttttttgtattttttgtagagatggggttttgccacgttggccaggctggtcttgaactcctggccttaagtgatccgcccaccttggcctcccaaaatgctgggattacaagcatgagccactgcatttggccgactcatctaatgttgacaggtgtcttgcctccctccttatctcttttcccagctggtacttctgctacaaatgggatttcttcatgtaacaggaaaatggtctcccatcagcccagcttatattacttcagtgtagctggccactcctgtctttcagagctcagatacaacacacccgagaattttctcacaggcccattttacatcaggtgttccgtccttagaccagttacagcccaggaaaatgtggttctctgatcagagaggatttccgcatgggctctgtttctagaaaaaggaggagttctgggtacagagcagataaaaccagcacagtccactacacccccaacaacgagggcacattcattcagtcgcaggtgccttccccctgcctggaatactctccaaacccaacccacttgacaacctcagcttttaagaccaaggcttccagcacacacttgctcacactcatcccttaacagagttgaatccatcctttggaccaccttatgcccttgtacatgcctcaattatttcactcactcactcacccactcactccctcctttgttaatttaacaaatgctggccgggcacggtggctcacgtctgtaatcccggcactttgggaggccaaggtgggcagatcacctgaggtcaggagtttgaaactagcctgtccaaaatggcaaaaccttgcctctactaaaaatacaaaaattagccgggtgcaggggcacgtgcctgtaatcccagctacttgggaggctgagacaggagaactgcctgaacctgggaggtggagattgcagtgagccaagatcacaccattgcacaccagcctggacaatatggacaatagagccagactctgtctctcaaaaaaaaaaaaaaaaaaaaagtgcttagggcacgttgcacccaactcctcttgggttgtgagtttcttaaaagcaggaatcatccctgtcatcttgggatctccaacctttgccagagtgcttggcccactgtcgaggctcggtaactactggaggtcacaaccttaaatgttggggtgactgcaggacttggccaccccctggccagatggagaacctggggtgctgggtacagagggaggaactgaatgccacaggttgcccagcttaagtcagtaatttctctatagtcattgcatatccatcataccctagactttcaagaaggactctatgccttctgtagcagtgaatggcagaattcactctataacacatgcctggtttggcctgatatattgtgcataggaagtgcttatttttcacatattagatctgagactcttaagaggtcatggtggccaccttgaattccctggggttatgaatttcttcgtggtgttacttgttagcttgtaaggcaaccccttggtaataaggggctacttgctgtctcctggctactatgtctatcagtctagttttcttctctaggatcgcagggaaagtgatccctcccctttccagtggccatttcacatcatgttcattcatttattcatgtgttcatatatgcattcattcatgcaatcatttatttaaaaacagttttgaggcctattttgtccaagacagtcaagtcctctgttcccattgagctgacatctttagaaaagagaactagacagttaagcagctaatcaaacaaacaggagaaataaaattgtcacagagccatgaataaagaaaatagggcaaaacgagggttggggcaaattttgatagagtagacagaatggtggctttgaggacgaggcacctacacgcaatgtgggagaagagcatctagggaattgaaggaagagaaggtggtcagtgtggcttgtgtggcagtgagggaggcgagaaagatagaaaatgaggatggaaggctgggtagggtggttcatgcctgtaattccaacactttgggaacctgaggcaggaggatcacttaagttcagaggttcaagaccaacctgggtaacagcaaaatctcatctctacaaaaaataaaaaataataataaaataaatttaaaaattagctggatgtggtggtgcgcacctgtagtcccagctacttgggaggctgatgtgggaggatcgcttgagcccaggagtttgagggtgcagtgagtgtgatgacaccactgcactccagcctgagcaacagagggagaccctgtctctaaaaaaataataatttaaaaaaataaaataaatgaggatggagtggcaggcaacccatttgggaccttgtagccacgataaggcactagggatctcttgtcagaaagagagacgccttttgagggtttgaagcaggggagtgatgtataattttgtaagagcacttcacatgtgggatcttgaggtagatttccaaatccgtaaagacaatgaggagcttcctgctacttttattttgaggaatcagaaaggttctgatttagaggtgagttttggaagccctggagagagagcaccataatatctggagccagagtcggggatcccaaaacaagccatgggattctcctcttggaaggtggtcttggaagggcatcctctttttttagatagccaggtttggtgttttttgtttttcccatgtccctcttatgaattcccagcaatggggaaaaaaaataggaggctggccagcaggagaccttttattatttcctcatgaagaaggatggggttattcttagtaagacaccacgtttgctgccactgttgtctgtgatggaacccacgctgccagggaggagtggatgtctcattgtcagaaccagggccatggacaatgtatttatgtgttgttttttaagatgcacatccattaaaaagaaacagacaagcaagcatctagtaaaaacattgccacacatgatggataaagggcagtatccttaatacacagaactcacctcaataggaaactggagaccctattttgttttgaatggaaaaggatgtgaacagacttttacaggaaagaaaatgcagatggttaataaaaagcatttaatttcactagaatcagacaaatgcaaactaaaacaatagcaggatacagggtgtcttttggggggaattctgttgtcaaattgaaaaaaatatttttcaaaaactgcagtgctggtgaggctgtaatgagatggacattctcataaacaatttgtgagatgtaccttaaaaagggaactttttttgggtatcttacaaaaagcttacaccctttaatccattagtcccacttcttaggatctatcttatgaaaataatttaaaataatggcactgatttgtatatgaaatattggaaatagcttatatgataatagtagatgattggtttacttaattatgatatatcattcagtgaactattgtgtagaaattaaaaattatattttagaagatatttttggtagtagagaaaaatatatacactatattattatgtggaaaacattaaaatcaaaagaaagtatggagcaattatgaatgtgaatgcatattatatacattgaaattgatcattggatcaaaaatgtatatacaaaggttgttaggagtttcctctgcattgtaaaattatgagcattttgtttacttctttgtacatgccaaggaatttttgtttttttatacacaaagaatgtgtattacttttaaaatcagataaaagtagcaaatggttataagtgctccctattgccccagcctgggctgatttttttgtgttacttaaaaataaggaatccaaaaatagtttgatctttggtggtatgaatcaaacaatgtgtgaatcctcctggggccctgtgatggagtcaaaagcatgtggacttggagccagatgacctgagttccaatgcggctctcctgcttctgagctttgtgattcggaaagttcataatttccctgggctgcagtgttcccatctataaaatggggagatggtccagatctttacccaggtctgtttgtgagcactcatcaggatcctgtctctagagggacctagcaaatagcctggcatgggctcggccatcaaatccctactcttgctgctttccagaggttgctacttgaaaaaaaaaaaaaaaaaaaaaaccaagatgtgttggttgatttgagatctgcaggaacaagagccggagccatgaggctacacagacctggccctgctgcctctctgcagcgtatctttttgaacaagtgacttagtcttcctgagcctcagggtgctcgtttgtgaaatgggagttgatgacaaccctcacctcctagggcagttgtcctcaccatggataatacatacattcagtagagtgcgtggtaccttgcagaatctcggttgattcactttgatatatttttttctggttgcaaatgaaatagatgttcaatgcagggaatttaggaaagagcctgtgagagagagagagagagagagagagagagagagagagaatatatatagtgtttccagccctttgactttatagtggagtagctgtgcctttgcatttaactgccctcatcccccacctgctcccacttctgaactaagctgccgccctgcaagtcagtgctatcatccccagcaagctgtggccggatgccctggtgtttcatcaatgtcccagtgtggtaacactgctgttggctttctcagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtggtaggtgacagggcaggctgacctggagggatctgggaggcagtgggtggcctcccactctgcgacaagcccactccccagcatggaggcctcagtagtaaaaattcttatttaagcaactgaactgaacttggatcctagggctcttgttggaattgttgcctaacaattatattaattttatattttatatattattatggtaaatatttataggccgggcacggtggcttatgcctgtaatcccagcactttgggaggccaagacaggcggatcacctgaagttggtagttcgagaccagcctgaccgacatggagaaaccccatctctactaaaaatacaaaattagccaggcatggtggcgcatgtctgtaatcccgctgtaatcccagctactcgggaggctgaggcaggagaatcgcttgaacccgggaggcggaggttgtggtgagccgagatcgtgccgttgcactccagcctgggcaacaacagcgaaactctgtctcgaaaaaaagttttgtaataaataaatgcatatacgttaatatatacatgttatatattatacatgttacatgtaatatatgatatatgatattacatatatgtaataattgatctttgtaatatataatatataatacagtgacaatatatgctattaataatatataataacaaaacatgttattatataacattatgatatggtgttatgttataatattagtcataaagatgcaccatattgttttatgaacattctatcattattgttaacagcagactccatttattgagcacttactatgtcccagaaaactatgctacctggcactcaaactgtcgctctcgtgtgaagtgagtgtcaacccttcattttacagagatggaagctcagcttcaggccacttaaggaacttgctcagtgagtggtgaggccacaatttaagccatctctctctccaacacccaacatttaatttctcttcttttattccttagtttcagtcattcatttgatttatttgagtttccatccaaatgttacctgtaagaaagacttcttaaaataccactcctcgccagacacggtggctcacgcctgtaatcccagcactttgggaggccgaggcgggtgtatcacgagatcaagagatcgagaccatgctggccaacatggtgaaaccccgtctctactaaaaacacaagaattagctgggcgtggtggcgtgcacctgtagtcccagctactcgggagtctgaggcaggagaattgcttgaacccaggaggtggaggttgcagagagctgagattgcgccactgcgctccagcctggtgacagagcaagactccatctcaaagaaaaaataccactcctccactcgctcaagtactctcaaatcccttaccctgctttatttttttcctagatacttatctccacctagaatgataaatttatccattcatttgtgcattatctgtctccctgattagaagttattcgttcatgtagcaaatacttcttgggcacttactgtgttccaggtgctgttgtaagtcctagaaacatagcagtgaacaaatcagaccaaaatccctgccctgtggatcttacattctagtgagcaggggcatgtgcggtgctttaatacttatgccaaatatgcaatatgtcctatgatcagtggcaagggggaagatcaaggacagaaagaggataggtaatgtggaggcttggggtatgtagaaagtgctctatgaagctcatagctgtctggtctgtggtgttttgctatctctctgtgtgatcacctggtggtgtagggtggtagttgagagtgtgagctctgaagccagattcctaggtccaggcttctccacttatgagctgtgttactcgagcagcaaccccattaacctctctgaacttagcttccttatttggaaagtggtggtagtaatagcgccttcctggtagggttatgatttaatagatgaaaacgcttagaatgtggctggcacaaagtacacactcaataagtggtaaaaattttcactgccttagatacctggaacaagttccatgtagagttggaacactcagtacttactgaatggctacatgcattaatttaataggtatggatagaatttaccactattgtcatggccctggtctccttctcattctgccctaactgggctttttggccaatggcatccaagattttcgagtgccactgttaggaaagggtcctagatggtgttagcccttccccaccttttatcacagttatcacgatagtagcaaccacaactcatcagcactagccgtgtgctatcctgagcccttaacgtgcatattgtgtttaattcttagcacccttatgagtaggagttgctaatatctccatcttacagatgaggaaactgaggctcacatagctagtagaaagtggtagagctaggcctcttcaaaactcatgtgcttacctgcggaatcactctccctttctggactccaatttccttgtctgcaaaatgagggaccccacacacacatacatcgttttccatatttctgagttctcttaaaccctcgaagttgactccctgttgtgctgcatctgaaggctataccccaagagtttgcagaccaatcttgggtggatgcagaaagttcctagttactctgttttcagtgtccaggctcttagtattgagtgacctccaagtcaggttggccactcctttaaccactgggcatccacatgggaccacaaattccagttgattcctttatcttgttcggaatctgatttgctcttctctgcttatatccaccagcagctctccttcaccttctgggtgaattctaagctttctggtcaggcctttaaggctggtggtctgtgatggatcatgcttccacctcgtctctcatcatcacctgcaactgacgccacagcatggcagctgcagagggtctccagcatacattagtctcaatgcacacccggagggccctttctccttctcttatgtcgtctgctccaggggatcatcctgactccctactctgtcccccttccaggtcccttcaccccctatgcttccctccagcaagatattagtgtcacagccatgcacctgcagcctgtcttccttcaggccttgcccccatattcagcttgttgctccaataataaagcatagcgacagagctcacctttgagctccggagacagtagctagtatctggcaaaacaagcaagtgttgaagcaggaggagagcagtgggaagggatgtggcttgagctgttggaaatgagaggggttgcaacagcagagaaaatatttattaatataacacctagcattttagcactgctgtggacaaagcactgcctctgacacactgtatccttacaacaatcccatgaggttggatctccagtttacgagtgaagaaacgaaagctcagaaacctgaattgacttcccaggttatacagctagtaagtggcaaagcaagaatttgaacccaggaaggctggatccacatctaacaccatcaattaccatgcagcgctgcctctctagaaagaaggtatggcaggcaaggagcagggcatgaacatcagcaggtggagaaggacatggtgtgaaatgctgaggctatagtaagtgctcattaaatatggttgggctgaacccagtgttctgcctacttactaggtcttgggcagaaatggaggggttaatatggctagatgatggagaggatgaatgtccagccaaggaatctggtctttatcctataggcagggtaggatagcacctactgaagctcggctcagaacagtcagatgcttgaggcctcagatcaagtgggaggttttgttatactgggtgacaatagttgatcaatgttctctcctcttctatcctagttctctcagctcattaagatcttccattccctgggtcctgagaagttcccgcttgtggagcaaacatttttccccaaccataagccaatggtgagtgcccttttttactctgtttctttgcatgatgcggaatgaatacagatgacttgtcctcggtctctttggatggaggaggtggactctaggggttgtacactgaccacgcagactctaaggcggagtcacagtgtcctgtgggagtgcctggatttcctaagggaagtcgtctctccaggtgaaattcaggcaatagggcaaataacaaaggtgaaccacattccttggaacttggagattttcagcaaatcaggggacacgttctgggggcatgttagaaccagaggctgattataaaggtaaaagatgttttcaaggtgggatgttgttttacttgagccttttgtggaacctgatttcaactcatattttaataaaaagcagtaatattaatatttgatttgcattggttgttgaagggcagtttccttacatgtcctcttcactttccaatttctgaatgcacctgagatctcctctgggaagcagggcttagctcaggatatgtggtacagcctcccatttggaggatacctgggtggaagaggtgaatgtctttctgaatgaggtgaagggttctccacctgaagccagaaagtgttggggggaggagctctaagcagcaggaaagagcctgcaacatgcctgcttgcatagttgatggtcttcgtaaactggtcaaaggaattcaaggctgtgaccctgcgcttggccttgcagggaatgcgtctttgggaacagaataatgaatagagtataccatagtcccaggtggggacttactgtggctgtttgtagagtccaagctcaggcttctgggctagacagtcctgtttggagatactgatgggtaggactgcagatttcaggagtaatcactctaaccaagcagaatttctattgatgatctttcccctgtatctgatcgggcaagagtcacagaatccagaacatgctggttgagataagaagggcacatgtgaaacccagcatatccccaaaccctggatttttcttactgtatgcatccttacagtggggaaaattcagagttcattatcaaactagcctgaatttgaatgccagttctgtctacacactaggtctcaggaaaatgactttatctctgtgagccccaacttcttcaggtaaaaaccgtggatgattgtggagcaacctcatcgagtagtcaggatttcatgagatcctgtatataaagtgctgtacctggcatatagtaggagtagctttaaaacaagggtgaaaacctagaacgttgtcaatggtgggatgaaagtcaggcgaggggtctgcagccagcccagcccattgacagtgagaggccctgctgtatactctgaaaggaggttgttataagctctgggaaaaggtcaccagctgtcgtgagacctcatgagttcctggtgttcccaactaggccaagccatacttggaatttcaagcaggcagttgacatcaaggactgctgtttgcaggccgcccctccccacctccaccaggttgggattcttaggaagaaaacaaggagggctgagtaaggactccagtctgggggtacttgtaccaccaataggtgattaggtacagatatattaatacatccagattcagcagaactagggaggactctagcaatagaatcagggagcaaagtcaaggcagggcacctctcctaagattccttctgcaagggaaaaggactggagcagggtggggccaggccatagcggtgcatggagggagggatgtgtccaggcctggagctggggatagactttcaaggcctgctggtgtatacataactccccgtggcgtcagaacacaacaaggcaagagacagcagatgtgtgatagaaataaaaccactttactgtttagaataaaggacacactataaaaagtgaacattatgcaacattacaagacaatatacattcacggaatataaaattcataaataacatggaggaaaactgtaaacagtgctacgaaatttagcaacaaatacattccttctagacagggttcgagatctcttgttggtttctctccatcacttctgggtttcaggacagcagactggctaaagggaaaggcggatgctgggagaatctaagaagcctctacccccaaagcaaaaactattctccaagttctccccttcctctcgcctccaaagagccaatttggaagttgttgtcacatccacctcccctactttccattttgttttgcttttgccatcagatttttataatgtttgtctctcataaaaatactctagtgacatgttaaccttaggtagccagaagccaaacacttgggtgccatcttggggtagtccagattgtcaattgtcacatgcaagacagaggtctggggcatggaagggtagtgtctcctgggggccacagtttgccctagacagggctattccaaaaagtcatttgtttctttaattgttcaagaaccatgttgccaccatgaggcaggtctggaacgaggggagggtaaaagacaggagtctcccagtattacctaccctggacagagcagagcactggcccgagagctgagagcctgagcatggagcttccttgattgggaggcagaagagatgcccaaaggaggaagcgagaacttggaattgtatctcccatggccctggattcttaggaaaatcatggcttcccaactggatgggcagcaggacttggggtgaagtaaatggtagactacccagggccgagtgacacagaacaagaacatgaatgtagtttaaacttttttcctactccaggagccattgggattccaatagggaggaggctggaggagtctcagttactagttccttctatttcccccaattcaccagtctagctgcttgcctagaagtattttcctctccattccactgcagaatttgattcaggaaaatggcggcatgtgggtttcatttttctcttaaacacaatgtacacatattacagcctacacatgacacaagatttagcaaaataaaatgttcatgatatgattgaaatacagaagtgtctcagctacataaatgattttaaattatacagtaagtgaacgggtgaaataaacaaagctatagcttatagaaagctcaaaaccgccctctgacatcgctttgcgaaagacccttctttgcccagggcctcctcaccaaggcctaacagatggggatgtggttctgctaatttatcgactccgcagggaaacttcaggtgcctcacactcagccttcacccaagttcctccttgtgtgagagaggctgaccacaccagggagtgcgaatggccagatgcctcacagagaagacactgatgtccacttgtgggagggaacttgtgtaggttggtcaggggccccaccatgcgagaccttgaggttaaaataaggacaatcccaaaacatcaagtctgggctcatcccttcaaaaccagtgacatgctggcatcagcttctgctcacactgcctcacaaagaaggccaagcctcccattctccccctgccaaatggcatgaccacaatgggaaaggtacacggtaatgaaattgatcccaaggaaacccgatgccggtactctcttcccactctgcggttctgccaagcaccttgcctgggcacttgtgtgtgtgcaagactctacagtgtgttgtctgctgctttttttttttttcttcttctgtttcaattggcagctctgtttcctaaagtggaatgaactgaagatacaaatactaatagaagataaatacccataagctgaaaaaagagacagagagcaatcatgttcaatgtcaccatcctgccaacccccactctgtaaaatatacattatcacctactctcagcatctcacttttgacactaaaacttaaaataattttatttaataggagaatttatattatagttttatttcaaaaaaaaaaaaaaaaacacaacagaaaccctacaactggttgcaaactcaggctttccccagtgaccaacaattttaattccaagaggtgaggatctcaggaggtggcattcacccaccagggagctagggaaagggaaccaagctgtctccacacccaggagaggtgtccctccagccaaggcaggcaggacactctgcagctctccctcctgtgcccaggcccttgactacactctcatctgccatctgagctaagccaggaaggcagttaaagaaaggcccccaaacatgaagcagggacaaggagacggacaggggtcagatgacccatgatagggaagagagggtgctgacggtgttcagaatttcaaattttaattaaaatgaaaaaaaaatgtcaacttggaatgtcatgattttcttcaaacaagcaacgacaacaaaatagaagagattaaactattggcatatttaacagcattgaacagaattctgtgtcctgtaaaaaaattagcttatgtccccatgtgggtatatgcaaatgtgtatacaaacatatccccctaggtgagctaaacactattctggaaatagtatcctctacccaaatctacttggctatatctgtggatagtgtatggtgtgtgtatttatccaatttacataaaagaaagctcctggccaaatctaccaaagcgttttccaggaggaagtctggtgggaggcagggagaggaaagacattcatctcagtctttcacctgagcttttgtacaaggcaggcaaattgcctcctgacctcaggcagatgtttaagtcttcaccaactaagaaagctctgttattctggcctgggtgcttgctccagactcaggaacatctggtcaacacaagcatcactgggctggggaattgtgtgtgtgctgcatcatctccgactctcttgtagttccttccttccctccctcactcttacatgcagacacagacagacacagtctggttgggacatgcagtggcagctcctggtgtataacatctttcacacaccttgagtctatctgcttgctgcctttgactgatcctgaaatggttggcctttcagcaagttccttgtctgtgtcctttatgtattggaggagaagggcaaagggaagagggtctgggagatggtgaggtggggaagaagcaagaggggtgggaattacaatcctcaaatggagtagtttttcatttttgttttcctaaaaaaatagagattatattatcacgaagaagaggaatacaggttcctcattctttctggcatggcaccagaaattcccaggtggaaatgaatgatgtcaaaaccaaaaagaaggggcagggtggggccaggaggatagttcccaataaaccccatatgacagcatagacctttctttaaatgttccaagtgctaaatttgcaagaaaacaggcactaatttcattgtcatcatctgggaagagttagtgtccaagggaagctcagcgggaagggagggaagtgaggtggggcagggtctggcgctcaggggtctgtggcattgatgatgcttttatccgggggggcccatcctcggtaccagctgcagtagccgcccttctgccggatgcaggcgtagtgtttggactggtagccagggtaaccgaaattggagagcatgtcggtccagagacactcgttcttggaagtcacaaagcaaggcaggtagtagcaggacttgatctgcaattagataacaggcagcagttgatggactctgccatggtatgcccaggcctgaggctaccgagcctggattcagaccctggggccactgcatgggaagcctagccacatcagtccctcagtgatcataatataaatagcactagcttgagcatctgctgtctaacagacattctgataagtgctttgatattattctctttaattcttatcacagttttaggaggctctgagaggttaagtaacttgctgcaggtcacacagccagtaagtagcagaattagactactgagaggactttttcgtctcaggtgggagatctcagttgttttagggaatcgaggaattagaaaggttagagcataaactttggagtctagctgccctaggttggaaaccagattcagtgaactgtgggacctagggctagttacttaagttctctgagctctcatctgcagaatggagatcatagtaattaaaaccacacaggactgttttgaagatgaagtgagagaatggcccaacttcctcccacagcaggcaggctgcaccttggccctatacttgggtcagggggatgggcctggtaaagagagaccttctgtagcatctggtctctgcagtcctgggcccatttgcctacctggggtggggttagcgatgagtcagctaccagggtgagcccacttgaaaccacttgggagaacctgccagtgtcaggatcctatacctccagccttgaactgccaggtggggccagggactcaagagccctcatgccccagcagcttccaagtggtcatcatggaggcagccgattacagcagaaaggcattcttccttccctgccttcctcactgccccacctggggcaacaatccttactatatctgctcagacctgcccctctgccctggcctaacacatgcatacccttcccagccgagggcctggcacccagtgcattgggagctgatgtttctagggctgcaagtcagcacctcccctccttcccccagtgaccccagagcttaccttgcagttacaacccaggtgataccgatagttcagccccttgcgctgggagagggtgagctggtcccacctctccacgaagttgcacagccccgtgtacatcttgccatcatagacgcgacctacaggaggaaagaagaaaacaaggagaggttgttttgtccagagcctagcccagagagaattcacacctactatgttcccacttagcccaggcactgtggctgggtacttttcagacccatgattttatttcaccctacccaacaccttttaaaatggactgtagccccattttccagatgaggataatgaggcttggagaggtaaagtgatttgccaaaggtcccaagcccattaaatactggagctaggactagaggccaactcttcactccctttataatgatttttgtttttgttttctcctttactacactgactgcctaaagatgaataactttcaaagacgggcctaacaggtcgagtgtgaggtggagaggaacagatactccctttttatttacagtaaagttgagaagctacaaattaggagatttcctcccccaggtgagtggtggagctaattccaaagtccagcctaagtgtaggagcctcaagctcctagcactgggtaagtgggatgaattcaacattagagactccttacaatttactggacatttggtgagtcaactactccgtatgtgttcttctgaagtcaagaaacagtggaccttggccaaaccctggcctagaagctagagttggccattacctgtcagcaggtactggtacttgttgacctccagcttaaggccacagagactctcggaagcttccgtatggatgtactgcacatggggcatcttggtgaagcctcggtacatctgtgggcaaaaggaacatcatgacttcttctttcccagtttggacacccgtatgatccctaatcccactgctgggtatgtatccaaaggaaaggaaatcggaatatggaagaggggtctgcactctcatgttgactgcagcaatattcacaatagccaagatatgaaatcaacctaagtgcccatcaacagatgaatggatagacaaaacctggtatctatacccaatggaatatgattcatccagaaaaaagaatgaaatcttgtcatttgtggcaatgcagctggaactggaggtcgttttgctaagcggaataagccaggcacagaaagacaaatacaccatgttctcactcatgtgggagctaagaaagtaaatctcataaagatggacagtggattggtggttaccagaggcaagaaaggtaataaggattggggcaaagagatataattaatgggtacaaaaatacgagtacgcagaacaagtaagacccagtgttcattgaatcagtagaatgactacagtaaacaataacttattgtatatctcaaagtagctagtagaggataattcagatgttcccagcatgaagaaacgataaatgtttaaggttatgaatatcccaattaccctgatttgattactatacatttttgaatatatcaaaataccacatggactctcaaaatatgtccatttattatgtatcaataaaataagaggaacacaggagaggagtctcagtacccagaaggcttgctgacattggatctgagggaatctcgctcccctattcagctgtccagtggccggtcactgatctacccaccccagggcccccttcaccccagatgaagccaccgatcctcttgactagccaggttggtgccttcccagagaaaccttcctgtgcagccagccataccccccattccaactgccccacaacactccttcggctacacatgtctgacatcccagcaccttttcagaaatccagagaagtagctgtgacaaaggtcctttttctttgtcaaccttaggacctgagtcccgtgaactcagccagcattctcatgatatctctgtgacactttccagcccacaaaaacattctcactcacattctccttgcagtatccttaaaagagccctgggagggatgtattacaaaccccactttatagaaattctatttggctggtgaacgttgaattcaagctagaaattctccatgttttttattcttctgagcgtctggtgaaagcattgggttcgtttatcccagatgaagcacataaatgtatctacaaagttcaaagagttttaactgttaaatactttataattgttagattgaaccacgtgaaattgctgatatttggctatttgtatctacgacataatctaatacagtggttctcaactggaggcaattttgcccccctaggaaatatttgggacatgtggcaatgtctggagacaattttggttgtcacaacagttcgtagagggtagggaggttgctaaacatcccataatactcaggacagcccccagaacaaagaattatccggccccaaatgtcaatggtactgaggttgagaaatctcctttaatattagcccacgaatcaccatgacaaccctatgaggtaggaactattatgcccattttatagatgaggagcctgagtcacaggcaggctaagtagcttgttaaggccacacagttgggaaatggcagggctaggattccaagcagaggactctgccttcagagtccatactcttacccattatcttagactggctcccaggaaagcctcagaagtctatgaccaaggtccccagaagcaggcaaatgctatttccatttatggccactgtgcctccttcagaggcacagtgtgtgcccagagtcactggggtgaatgaatgtaacagaagctgagtccgctttgtgattccaggtcaagtccatgagtattacacaagcccagtgtgccaaggcgatactgtgaactgtgagatttggtaacgggggcggtggggcaccaaggtgttgcacaattctgttatcccctcagttctcagcgtacacaagccctggactgctggtggtctctgggcttgtcccaagggtttataataggaaaatgcctctactttacttcctggcatttggtattaatttacctacagtaattaatacaaagccagacatctcttcattggtgtctcttctaaatgcctcccatttggcctgtgagctggcgttttctcatcttttaagtggtgactggttggcgggggtaggtggtccacaagaccttcatagcataacttggtctgttggacctactgagtttgggcgcccctgccttgttaaaagcacacattgttctgatggactcagatggtcttccttctgaacctctcttctcccccaaggcttgccaactgagcacggtaacgcagccaagtgctggaagaagtgccgtccacactcagcattcaattacgcggtgggggcgcggggtgggtagagtcacgatgatgacttcttctatgtgaatggtgcctctctagccttaacaggaaccatgtttaagcgtgctgctgtatgcctgccatggagtgtggccttcgaagaacatcccctaccctgacttctgtgccgagcaacttcttatttttgtgtgggtgttccttgaggttttggcaaatgtttcaactaagcactcgctctaggtcttttggacccagcccatgggaacctcattccttctgcgtcagtctttccccttgactgccctagtgcttcgtgggtgagagaatgaagcccctggttacagtctggtcatttgaactgctcagtaagaactcaactcatcgaaatcagcttggcaccgcagctacttggaagtttgaaggaacctgcattttagctcctagcacttgcctagagtcgaaattctgacacattacaaatgactggctctgacaaacatagcgctgtgttttagggtcaattctgaaaagaacaacatggcaaaggtagattctactcagttgtgttttctgtgtaataatcctaccttgatttaaatattgattctaaaagtatcatgtctgtaatcatagagatctagaattggtttgacaaatttaggagagttataataggtttataatgtcctgacatcagagaatcctagaatctcagagttggaaaagatgttaaaggtaatctaatccaaaccaatgccatggagatcagtggtaaattcaggttttggaggctgacagccagagtttgaatcttcaatcttctctgccacctgtgttcgccacttggaaagttacttaacctctttgggtctcagtttcttcatctgtaaaatgggtcaaagcacttcttagggtgtttgagagaagcaaatgacttagaatagcagtcagcccacaacattcaataaaagttagcttagaacaagttatactgaaattcgtaaggagaggaggaatgagtttggtcccctttctcctaagtcccttcctcagctcttaacaagagtagttaaagctggtttagaacttcagacataagtgggttgttctttttcagctgggttctgcatgcctctgggcccctcttcttcttcttggtagcatctacacaaagttccaagatgttagcttcccttggagtgaagggacaaataaagtaaaaaagaagtttctgagtctggggacatttgcatatttcttatgaaatgtctggccttcactctacattgacagcatgagttgcctcaatgattccaactatgtcttgcatgcctaccaaagatcaacactgttctggatgctggtgtacatcacggactcatttaaacccacaaattcttatttacagaccgaccgagctatcacggccatgatctttctctatacagcaatttgtctagcaggacaggcagagaatgtagaaatggagccagtctctgcagagggctggatgagagtcctaaggcaggaagaaccacgggcattgcaagaagaatggttccctgtgggctgggggtcaaagatgcttccagctagagcttcaaaggcgagaccctgctattgctcatttggttagacaaaccactaaaggaaggaagtccctggaggtctgctctgcctacagtcaggacatgcaaagcacatgaccagcgggtctccccatgggaccctcccaggaccagctgggacataatgtcccccacgttctgtcccctgcagccagctggagagcatgtctccgctacataaacaataactcctggcacagtggatcggtttctcatggtcctgatgggagataaggtccccacagcttagagcagccagttctggaaactttcaccttcaccccacagcccagctaatttccaagtttgggattgcaataagctctctcaacattctaacaccctgctccctcacacacacacacatatcgcaggtctctgtgtactgaagtgttcctgagagatgggtcagaggctccagagttagcagacgggagaaggtctgcctgccttccatcagtgagagaagagagaggtcagacagggcggctcggagtctcaggttctccaagttcctttagtcctgctctaaggaagcccttgctcaccccttctgactctctagggtagactgtctaatctgctagaacaaagtctcccagggaccagtgccaaaactcatgcaggcttgcctctctggcctctctctcttccctcctacaaagatttttctgatacaccctttgcaggatattacaagtccagccctacactgctggatgataaaccaacaaacccaaactgacctctttttgttccctgggaactaaaaacatatggagtgggcatttatataccccaaagtgggtaggaatgatgaatcagcctgctgctccatactgtattatctccttataggcaaagaccctgtagttttgctcaggtttgccactttgtggccatataatcttaacagttatatgacctcccaggtctcagttgcctcacctgtcaaacagaggacaaggtgttatctattttacagtgttagtataagtactgatctatgcaaagacctagcagaatgcctggcactaagcaattgctcagtaaatgttaactgatgccaagtcttatcataattataagcagtgttatctttgtatccccagttcatagtacagtactaagcacagagagagggtgggaaggaagcacgagaggatggatggacggactattacttctagcctgtatcttgtctgacttgcaggctggtacctagagacaagcagattccagtggtgtctctggatagaagggcactgaccagttctatggatcatgataccctctatggagggtcagagtgaatgaaaggcatgagatggtgactgatgattaagatggcagggagatttgggagtcatataaagaacacaggattgggaagaaattccgatgcctcagcttggggatcagatctgcccttagttaaatgcttgactctgagtaagtcatttcccctttgcgcctctgtcagaagtaagacgagggatcctacatctaattcccagcaccatgattcatgagctcaggcgaaggatggtgaaccgaaagcctaagcccaccagtctgggagtgggagtgtgtcttctaagcccaccagcctgggagtgggagtgtctgatgctgataggctagcaagtgttgtttggtctctaaacaaccacccgtggctggtctgacaccagcaagggggaatgggacattatgtccacaggaagggcctctggtcaccctggtctccaggccctgatggtaggaaggaaaccaggcaggcttaggaactgctgcctcccagctatttccctctcagctctctgctgaccaccgagtgtctcgtaatgaggattgttccagaccaggcaggttcgtgtgttttctgaacctctgctttggtctaatatgctttggcattcccgcgctgtctgccagaggttgcaaagtgggctttttgcgttgttgttgctcttgctggttccccacccctgcccatttttctctccccagggctgtctgaagacataagctggtctcatgaccaagcttaggcagccaagggcaactggccagggctgactctggacattacataaccagaaggctgtggatgtttgcaaaattgaatccaaagcaacaggttccacaaaattagtacatccagcctcaggacacaggaataagaaagcctggaggttggccttggggatggttgggtaccaccgtgggctgcgtcactcctccactcccttctacctggacattgcggcttgtctcctctggggagtttccaggcctgtggggtctcaccctcatgcccgtattagacagataagcattcaccaagtcacttttgcatgccaggtcctaccctaattgctagggatgcaaatatgagcaataagttaaagggctggacagttcctgtggacctcagcacaccccacattgaacttctgatgagtcacacacatacctgcctcttctctcccaacctgactctagttcctaaagatggaaactgtatctccctcacggcctccctggctcctagctgggagctctgcatgtagagaggtgcttacaaagatggggtgatgaaccagttgctgagttattcaaggtgaagccccagtcttctgtgctaaggcaatcaccagtacacccttccattgtataccacccgctcctccttacaagtaacatggcccgcatcccagggtgcttagaatgcctgagctagagaggatgttaggagcaccaagcccaaccccacactgttaacaggtggcaaaactgcggcccaggaaaagggacaagcccaaggtaagcaggctatttaggagtagaggtgagactaggaggcaggttctctagatttcaaatctggtgttctttttcttaagggcatacctccttcctgtacttcatgatgttcatatcctcagtaatatgtttaatgataagaatatgcttagcaaacattgctaactatctaggatgcaagaagacaatcagctgggaaaatagggaaagaaggtgaagttcctgccttgggatgaggttcctgtgatcagcacagtttccatgtaaagatttgagggctgtaaacctaagctgtaacctcagtggctgcatgaaacctgtaagcactgttgagtcccagatagtcagagctcagaagagttcatagagatgatctagtccaaccccctcatttcacaattgggaagattaaagcccagagaggggcagtgacttgaccaaggtctcatggttacgagctaacaaggctatctgccatctggctccagagctcagcttcctaacaagtgccttggagtgactccacctgcatgggctcttggacaaggcagccccatgccccctccctacccatccctttatgcagccttagcagctccctctccagcaggcagaagggctgggtctggctggtgcttagacacacaccccagttccaacccactttgcctcccttagccaggactcttctggcaaaaacccaaaaaccttcccggagccagggtgatgacattacctaccttcatctgcttgatggtgtagaccagcgtgccgaagggcccctcctttaccagcttcttccccaccaccttggcccggatcactgcagagacagaaggagacaataagaggttaggaaggcctgaaccacatcaggaacagcatctcagggcgggcacgctagcctctgtggagcctggaattgcactcttaccttggagccaactggaatagatgattgtgtttacaagagtgggaattccctggggtgagagggaggttggaggaaaaagaaacagccaccattcaagttaattaccccaaatattcacaattgccagctccagaacttccaaggctatagtcaacccccgccgaccctgaggattttcttgactttgtgactttaccataatccaaaacctacttctcctgttagagccattgtcccccctcccttgtccatctgacaatgccatggtctcccagatctgttctctttccactaggacccctttctaaccacctcatttggggctcttcctttgcatgcattaattcaccacatcttgacatgtctacagggttgtggtgcaccctagcttcccacagtgcccccagttagcattctgattgagcccttggtatccagtgcttagatagcaagggatgcaatagagtctgagctctatggggatgtggttagaagaaggagcaattgggagtcggggctcaggagccagacagaactgttccaatctcagctctgctgtttatggctattgcgactgtatgcaagtaagtaactttgtttctggcctcctcttctataaaacaggaatcataatgatactaatctcttgaactgaagggattagtcaagatgacaaatgtgaaactcttgatactgtcttggacatagtttgcactagacaaatattattaatatcatcatcattatcatcaccaaaaatgaaatgggctaaccatggaagggctgttccaatgaaaacagctcccatttattgcacacctactatgtgccatgtacatttcacttatttactgctcttaactgtcttacaagggcagtattagcatccacatgatctagataaggtaacagaccaagaagtgaaaccacttcctctttctgagcctcaattttctcatctataaagagggtataactctctttacatcagggaattggaatcaggattgaacgaaagatcttatgaaatttcccactacaatgtctggcagaaaggatttacccagtagatactagttaactatgaatacaaaagtaattacacccagtgggttgagggctgaaagagaggcatttaccacatgcactgggaacagaaagaggagaggacttgacttttagattctacaaggttgtgcttctctttctacgttgtgtgaaaaagaagcacccaagagctgtcttcaggtatttgtaaaattggcacatggaggagcaaatggacaggtcttgaataccaaaactggaaattgcagagagtaacattcattggctcaaccaaagaaaaaaatcgtctaataataagaaccagcaacaaaaggcaggggggctgccattagggcagagagtgcctctatcagggggtgtgatgagggtgctggatacttccatgctaagacctcaacaggaattggaatggggcttgcttatgcagtcatactttgaattacaaattgaactccttcagccctgagatcctatcaatctttcttatctcaagttgcacttagcccaaaaaggagtagatactcaataaatgcttgttaagtaaaatacccttcacacacacaaacacaaacacacacacacacattttggtagctccattatccttcctcattgtggatgctccactatgtatcccagttatttgactctaatctctgtttttaaaaaatctttactaagaactgattcctcatccatactggattctgtcttgtttctttccaaatgagcttggatcctacccttgcagtcagacatgaagtcagggttcagatgaatcaatggccccttcagaccttccctgccggcgatggcaaaacacacagtcattggcaaagtgagcaatttagcggaggcagctcaaattaggaggaggcgagtggttgtttccaagtctgctgtaaaaacgagaggttggcaagatcccaggccaatgtctgtcaagatcctgcatccacctctgtttctaacattgcggtagtattctcggcgacaagccagcctcccggaggccccggggactgtttcctccatattaactctcacaggcaggttataacagcttcacctccgtgcagaggcatgtctgccagcctttaccactgattcttcctgaaatgatttggacccatcttctctgcctcattaacacagaaggtaaacaagggagcgagtcttggccggggggtgtgggaggggcaaggcaaaagggattcctttaaatagcaacatcctggttcaaaaatggcttgacttgatttagacagaagatgtcacaagcagacctgccccataaagctgagtactgctggaagcttctgcacatacaaccagccaactccttccttaccccaaatagcctgagcttggaaccttttcatctgaggatagttcagtgaaaagaatacgtttttgtagtcaggaagctgcattgaagtttgggttccaccattactgtatgatctctctggggctctttcctcctgaatctctctggctttcttagcccagtgcctctcatgtggctaacaagtgatttgcttattactattggagcagcaacatagcattgcattaaagagcctggtctctggagcctgagagccagggttcaaatcccagccctggtgctgggtgaccttcaggaagttgctaaacctctctatgccttggtttcccaatctgtaagatgggaatgatgaaacaatgcctcataaagttgctgtgagggtcgtattaatataagcgctgagaacagtatgtagtccatcccaaacctcatgtgtttgctaccactgttattagcattatcaccactatggtgatgtctatttttattccatcttagggcataccatcttcagacttctaacatgcactgtaagctaaggcctgggagttctccctaggatgagaagaaaggcaacctcataaaaatattctagccttacagaacttcagggagaggtggagaagcacagatgaagtagtcagaacaagtataggaggtattttgggatcaggagtgcctactctatcacatgtacccatcccaccttatcacccatgtgtaacccaagaattgcctactaagaccagccaaacaagatcacagtcatggttccaaaagtctgaggcagagatggcccagtgaagaggccacatcagtgttttccttacaaaaacaaaacttcactaaactgaactaaaattaagttacattctgccctccaaatagattctcaaagtccttccaaagtagaattgctggccaaccccagatccacctatttggtttgtgcattaatctgtccgtatttgctccagtttctcctctgtaattcaaatgtgtgctattttgtactctcctgtttggcaatcagggttctcccgaggcattcgctggcccaggggccacagggaacaagggaagtggggtgggaggaggttgtgcttttccaacaacagaagacacttttcaaactggtaactggcagcatgtctagccattccttccaccttgttgtggtggctagaagccagctttacagatgggccaggctggacacaggttgtctttattcccattcatgctggagtatggcccctacactgtctacccagtgcccccaacaatcaaaccaacataggcatgaactaggttggtgtctggaacattgggttgggtgctggtgagggtgacaacaagaaatagaagtcctatttcccgcttccactgatggctagtctagtggggagataaggtttaaaagtttatggctggccgggtgtggaggctcaccactgtaatcccagcactttgggaggctgaggtgggcagatcacgaggtcaagagattgagaccatcctggccagcatggtgaaaccccatctctactaaaatacaaaaattagctgggcatggggccgcctgtagtcccagctacttgggaggctgaggcaggagaatcacttgaacccaggaggtggaggttgcagtgagccgagattgcatcaccgtactccagcctggaaacagagcgagattccatctcaaaaaaaaaaagtttatggctagaggactagtctccaaggtacagaagcaccaatcagagaagggagaggtgaggctcagtgtgaatctcagcctctgagcctctcttgtctctctagaatttcttttgctcttaggaagagaatctgggcttctagggatctggtggtcaaaagaagcaaggaagaggctgggtgtggtggcacatgcctataatctcatcactttgggaggccaaggcaggaggatcacttgagctcaggagttccagaccagcctgggcaacacagtgagaccttgtctctataaaaaataaaaaattataaaaatttaaaacaattagccaggcatggtgccgtgtatctgtagtctcagctactcaggaggctgaggtgggaggattgcttgagcccaggagttcgaggctacagtgagctatatctcatgccattacactccagcctgggtgacagagcaagactctgtctcagcaaaaaaaaaaaaggaagaagaagaaacaaggaagagattgattaaggaataagcagtatttcaatgtaaaagtatctaagaagaaactaactaggatgtgtgaacttatataatgggcacattgatctataaatatatatggggccctcttgaatatatcatgcgcctgagaagccaggcatagaggcatatatctctattgaactgtctttgcttcctttgaatatttgtttgggcaagagtgctagtaagagcttacaaaagcaaggcaaacaaggcacacctcttccataaatataccttcatgctgcctctccccacctccagctctagcagtatggaccacagtggcacaagttttgaacaaagaacaattttccaatggcaattgggattgagtttccagaaaagcttactggtgtgtctccagaaattgcacatgtgctgttcatcagcataaacagagtggggcaagatacccttgagctgccctccctctctctctctgcttctatcccccatccaaccattgtcaaccaaatccagacccttcttccccgacctaatggttggactttcctactggcagactagaaggccgagcaacaatgctacccatttggctggtctggggatcaaggactccttaactaattaatgtatactaacttaggagtccaggttccacccatggtagcatcaacggaagagcagtacaaatcctctccatgacttaggagttgattcatgctatctagcaggtgagataccaccgccaccccacacacacacacaacacccccattcctgtctctccaaagaccccatagaatgattttgctgctttaaggcatggtttttaaaaggacagcaaggataagtaagggacgtctggttagtgggtagactgcatttcttcaaatgcagaagtcactgttagtgtcagtcccagggaaggggctgctcttctgatgggaccccagcaggcaggctctaggtaggaagaaaagcctggaccatgggctcgcatcttcggcctagacttggaggaaaagagggatctggaagtgttggaatgatgccctacccatgaaaacacaccaaaaaggaggaaagagggatccctgtcacccagcttgtctcacggccccttcgtgtgtattttatcatctcccacaggatgacaaagggagcggccttgctgaggccggagtgctcatggcaaaggcaataggtcagggacccacagggaggtcggcctggagcccgccaagcaagcctttttcctgcccaccttggacactctacaatgtagcctgcccaaggagggcagagccaggctctctcactcttccagctgctcacccattcaagaattacaaactgcttgcttttcttagcatcacattagtgaatctagaggagaaggaagggaactagaacatactgataacaaccactaccatttatcgaatgcctcttaggtgccaagcaacgtgtgcatgttctttaactctgtcctcatggcaagctggtaaggtggctactgttgtggctgttaatgtccctactttccaactgtggacaatgaggatcaggtagcctgtaagcagttttgcatcctagtgggggaaaaaaaaaaatgggaggtcccccaggacagcagaccacctaaaaacctttacatgggatttcacactggttgcaaaatagttcataattttactgcattccccactttcactgcagaggatcagagaagaagattgatacctaaaaggaaggacccttgataagctcccagtgagccccacatccctttgatcacccacccaccacccttcccaatcacttacacagacacacaaacacatgtcctctgattagtaataaaaatctagaagtcatcgccatcagcagtataacagtatatcgtatcatctgtttagacctttgtgctccccggcaaggctttcatggaataaaaacaaataacttagaaaccacaaaaccacaggctccctaagggttctcccaacacaggaagtttgaagttaattagattgattaattaaatgagacaatgtatatgtacaaaggtactttgtaaccctgaagctagacaaatgatacactgttatattgctgatggtgatgacttgtagattcttaaatttactaatcagaggaaaacagcaagaggaacccgaaagattcttgtgattcagcatttcctcatccccccaggatcttgagaaccttcctcagtgacccttcccaaggtccttctcagatatctgctgcctctctggggatgctttgatgatgtctaggtgagaggaaagggccttcggaactaagggtgaaaagcagaggcctgaggggcctgcctggactgggtccctctgattcccagcctattgatcaccacaatcccaactcccaaaaaaaccctcctgaaagactcagaagctgaaaggacagatcaagaaaactggagaagtgatcacggcgtactggaatgaaaaacaggcatggagcacgtggggtctgggtgaagtcgctgccctgtttctctgtgaccttgggcaagtcacttcccatcccagcagataaattgtgggtgataattaccagcctccaaaggtgcctgcaataacctaggcagcctcccccctaacctctccaaagcagtgcttgtcgaagtcacccatgaccttcttggtgctcagtccggtcatcgaggtgcaggctcgtggtcctgctatgttcttccagcttgtgggtctcagcaccatctgcacaactgacagctcccacgcttttgccaccgccaacctagaactctcatgaactttttttttaaacaaattgtatttttattttaagttctggggtacatgtgcaggatgtgcaggcttgttacaaaggtaaacatgtaccatagtgatttgctgcacctatcaacccatcactgaggtattaagccgagtgtgcattagctatttttcctaatgctctccctcccctaccccacccaccaacaggccccagtgtatgttgttcccctccctgatgatctttttacttatatatcccagagtctacatttagtctacatttatacctgcaagcctaataaaacatctcaaattcgacccatccaacactgagctccagataacaggccttccctgcacccggggctctcatggccttcttaatctcaggaaattgtagctcactctactgcacaccctagcacccaagcatgctctcagggtctctgaccttgcagttccctctgctggaacactctttcttcacttgggcgggggaccttccctgatcctgatccatgcacattcctccccctcctcgcaatcccttggcccctgacactgtgctctatcagacactggccaccatctgacattatacattaacttgcttctttactgatcatctctccccattaaaatgtaagcctccccgggcagcaggttctttgctttacctattgctgtagccaaagctgcccgaagagtgcctggcacataacaggcacctcatatgtatttgctgaatatgggaagctacgtgtgatttcttgtataaagtgccacacacagagtgatttaaaaacagataaataattcctgtgcaagctctgtcaaatgaccagtctttctaagtcttattcaatcaaaagggggtaacagcaattctcggttcacagggtcagatacacaactcttcagcaaccaggaaggtgtttcagtattgtgaagacgtatacagggatagagagatacataaggctcctaggaactcaagggccagaggtgagagagaccagcaatgacactcaagtaaggcaggctcagcaatataagcaaggacggaaagccaggacagagccaagaagagatgaagtccatctcaggggaggggtgtcagggaatcgccctggagatggcatcagatctgagcctcagcccatcctgcagaagagactcagtttgctgcgtctgaatccagaggaggaagaagtctggatctgatctgggtggggggcggagggggcggcggtaaggagagcagctggaagtgaggcagaatcacagccgggctctgagcaaagccagagccgatctcccgcctttccaggaagatgatgacccccctcccactgcaagagcatgggggctgggggctgggggtggggagcggcgagcagcctgagtgaagaggaactctctctcttcagagaagtcccacaaataggcttttcctgcatcctaccctggtcccccagggcccttctctcttgtccgtttcaaaggcccttttcgttgatgtcaacgccaaggccagaccgttaacatgcactccccatcaagataaggagtcccagttcaaagcctgtcctgactaactctttccgttaagtaaaaatattaatcttggttttatttaagcaggtttttttggcaagaaatgaatgcctgtggctaaaaataaacccaaagacacacactcagaaaatctggaaagctgcaaatcatttcaacccaagtttccatctcagggaaagctattaaacctggaggatatgaaaacctccctgcccagagattcctgtttctcagtacctgccttgtgttccggggtccccagggcaggtctgtcctggggatgccctgtcctggacctcccggggaaggggaggaggggcctttgtgagctcctggctctcctcaccttgtgagcaggatgggtttctgcttgagcggtctgggaaaaactcagggcccctgctgacgtctgttgtagatgaaatgaaggggccgggaaggggaggcaaggaaacacaggcttaggaaggtcaggcttcctggaactttgagattacccaaaagaacacaacacaaaattagcatcccatgctggccttcatgtgttaaggggcaacctcagttttacacaatgaaatgacaaaatttaagagtcgctccttctaggtatatgcctggacttgggatgaatgcatttgatgtttaatctaactgcttaaagtcagccactcttgatttcttcctggggccaccagcaatttggaagaaaggtacagataccttggcctgggacagggcaaaagtcctagggctggctgattcctggattcagggccgacttacctggggagggaggactgtgaatctcagaagggtgatggtgtttctgtgacctgggtttctaagggtccaatgaggcgactacctcaaagtgttcaccaagcatgattagaatccctgaggcttttactctgcaaatggctgtcaggtgggaaatgtcaaagccccaaaggatagacagtgggaaacacagtccttctcccctaagtcccccacattctcccaggaacaaatgggatccacaaccctcatttacatcctcacctacacctcccttgggtttgcagtatctacaggattattctgcatagctcggtggcatatatatggctcttcagagctgggaccatacctcaaaccctatcactctgaagcttccagcccccatcactatatgaacctgtcctatgatgccccttgcctaggtgagaatcacttcctccctgtgcatctgcctgcacctttggcttcctgcaagacccacccagctgaaatgctacctcctccaggaagccttctgtccaccccaggccaagctagtccacctctcttctgcttggctttcctctctttcttccagcacgtgttctttaatgattggttccttggacactcactagcatcgctaattaccggatggcagggactgcatctgggactccagcacatggcatagagcctagattgtggccagggttcccaaaaatgttgaatgaatgaatgaatgaggctgtgggagggaaccaaaggtaatacaataacgaagacggggatggttttgtgtttggcttcctggagtgctgggtcaggagtccttgttccatagagttactcagaaaaggaagggacaagtaaaaatgtgatctggagaggccgaataccgacattgttccaaaatattgaagactgacctccaaaaagaggcaagtcacaggaccctattacaggagacccccatgaacttgttgatgtgtctgtggaaggacagcacccaaaagctaccaacacatgaagatcccaaggctcagcaccctcaaggaagtcagtggtgacaccaaaattagccccagggagtctccacccaaggcactccttgctagacctgctgactcctctgcaggccctctggcctccagctgcccctcttccttgtggtagcactcaggaaatatgaagagcatggcaggctgtttatccaggccccatctccaggtcctgtgtccctctctgccatagtgtttattgtttgttttattttgccaccccccctccttctcctcaagtccacttgaaattcattgattcactcatctgatatttattcagaagtatttgaggaactatgcatctcagatcctgtgccatgtcttggggattcagtaataagcaggcagacaaggttcctacctttaagaagcttattttactcttgtgagacaagaagacagggagttatagtccagggagccacaggagcatgcagcagacacacccagccagcctggaggcgccggagggagacatcctgcctgagctgggatcagagaatcactagagacagttaagagaaagagaaaggagaggaccttctggtcatggttgggcagaggcccggaggctggagagtccagcccattggagagacagaaaacagagagtccaacaaagtacaggggtgccttgcagtgggcggtaactcccagcttggtaggttgggtcttgctccaacatgggacagtgccatttcttaggtgggcttctactccctgaggctagtgataaagacttatcactctgtcactgcccatagactttaggattgcatgtatccaaatgggtgtccaaacagtccattgacaggaggcccccgaagccccaagaaacccctagaaacaagcctgggtctttgcatcagaaccacaaatgatctcattccagtgcacatcccatttctaatcttcaacgttagtatttcatgcatctctgtctcccgccgtaccctgtctcccctcaagccctttcacctcttggagtggtttcgccctgggtgttttggctgggcatctgtgctgtgctctgaggagacatcaagtttaagggggcatgctgacctctcaaaagctcaagcccactcaggggtcagaggcgccgacttgcttactgccatgcaagtgcactcggtgaggggggctgagaccaccccctatcccctgagagtgctccagcctctccacgggggcccatgggaaactttatcccacacaagtggccaccagaatagcagcatggtcttcaaccacagcccctttgaagcagtgcccagaaaaataccatgccctcaaacggttctcagaacttccagctttcaggtcggggcatttttgaagcccaaacagctggcaacatctcaggagccatctatagcattttatttttctcctaattgggattttgtttgctaggagagctgagggactctgggataggcctaggagcaagtccaccattagccaaagaaccaccctcctttgcacgccagacccgcagatgcagcctttgcagacagcaaatctgttcccagaatgcaccaggagtgggcaggagactttcttgtggtttgaacaagagccaatggctgctctgtctatggattttatacagcacagatgccaaggagaccctggtacatctataacttacccttcatgtggcttttaaaatagtgtaggctttcctcacctttaagttccacaagcttcattctgtaaggttgtggacacccagggccatagtttggaaggcccacctgctgcagcgggtgttcccctactcactcagcacctcccttccagctcacaaccacatcactcacatagtgggcactcaggtaggaacaggtacgagaaaaacgagcccatacataggtcttcaagccctaagaccattatcaggaatcaatagcactgaaggtgcggaggaatgattaaagagaagatccaaatccttttaaggaaaccttcattttaaataaaataaataagtaaagaatgctaactgctgccctctttggtcaaagtgggtaatggcagaactataaagccaacctctggtatttctgaaccacctgccctggccttgaagtgtgacagggagatggagtcattgataaagaaggagaagaccaactactctatgaacatcgtgtctgtgcaatcatggtgcctaaacctcttattcattcagtaaatattcactgagcacttactatgtgccaggcattgtgtcaggtggcagaaacagaaaagtgaacaagacagacacactttacaaacagtacatcttactcttaaaaccattccccaaaatgtgtagctttatttccactgagtataggaagaaaacaagtctcaggatagttaagaaacttgtcagaagtcacacagctaggaatccaaatatgcccagcagcaaagctcatcttctttctactactaaatatttaacaaatctgaaacaccccaccaagtcaaatgcattggaaatgcggagatagggaaaattcccaagactgaattatgagagaagggcttgtataagttacagatggtgagaactttgaggtggagttaactctccataactcttgtaatgtctaagaatctcatccaatggtgaagtctggattcaaatctccacttacaagctgggtgggccccagggctctcaatgccagattgagggtaccttggcttgcagacaaagggcaggaagagagaagtccagtaactgacctgaagccccctggtttgaagacagggagctcagccctttggaccaaagagtatggcaaggggcgaacaagtatacttttttagacatctgatcggcagccctggtctaaatctctcagttgcaaagccttggggcctttgcacataccattctatctgcatgagaccctcttctgctccccattacccatcaactgccactcatacttcacatttaaaatcaaaaaacacttcctcacataaagccatccccaaccacctcctgcaagcataagactagaacagaacccctgttttgtattctcaggggccctagtgtgtatgtaactatatgttcgtagattcatttgaatcatgtctcatcctctttcttccctgcccccatacactcactaaattctgccggaattacatcttgctttgctcacaattgtatctaaccgcaacatctcacagtgtctggaacatagtaggtgctcagtgggtgaaataagacatcttttccatcttggcccttattgattgcttcctaagaagagtgtatcaccctacctttctctactgtgcactctgtcacccagtatgtgcaattagctgcaacattccaatgccaattccgctgcatgaactgactcagaagaatgtatagggttttgatcatggaaagaaaagaaggatggtccaggcaatggaaacagcacaaacaagggtacagcaatcagaccaagactgacaggtcggaggtcacatggctgaggactgcaaagaccctggctgaagagaaggggaggccactagttcattctgactgaagggaatgtccagttccctgggtgacagatataagcttgaatggaggattctttaggactgttccacaaactaggtctgttgtggatccagtcatttctgggtctcatgcagacccctctccaggtgccaggatggtaccctgtaccagataggaatcatattttctgggtttatgggccacccggagtgcacctctccctgcaaagcacagggccagctgtcctctttgaaggagggctgtaatgataaactgcacatgcctgcttctggacactagagtcctctagagcaattgccacaccacagagtatctgcaaaacatacacagcaccagccacctccccctgccacctccactgcacatctgaaagctggcagggttttgcctaagtgaccagtggctgcatgtgacacttcttactctgcctgcccatgggaggctcctatcaaaaggtgggcttggccgggtgcagtggctcatgcctgtaatcccagcactttgggaggccaaggcaggctgatcacctgaggtcaggagtttgagaccagcctggccaacacggtggaaccccgtttctactaaaaatacaaaaaaaaaaataaattagccagatgtggtggagggcacctgtaatcccaactacttgggaggctgaggcaggagaatggcttgaaccttggaggcggaggctgcagtgagccgagatcgtgccactgcactccagcctgggcaagaagaatgagactccatctcaaaaaaaaaaaagctgggctcaggtagtccctgaagcacacctccaacccctgttcctagatgttcctggctggaataacagaacaaattggaatacattttccattatatgccagtgctctcggaggataagcaatgagagtaccagggatgaacacatttggtcaaacactgacacagaaagcaggaggatggtcatgtgggtagttccccactttccctaattataaaaatcctattgtcaatgattacaatactaattctaatactattattagttacaataggtgccatcagctatcaggcactttccatgcatgatcagtgctaaatgctttccgtggattttcccatttgagcctcactagggccctataaagtaagtgttgtcattagcccatcttttagaaatcgaggcctgtaaagaagaagtgactctccccagatcatctaatgcggaagtggtggacatagcatgccagtccaggcagcctgaattgggagcccctacttctcatctctgggtcctacctgccttccagaaggacatgttaaactacggcacagtggcatgggcacatttcacaggccacagactttaggttgggtgggaccttcagggtcactcagtgtaagctcctttgaatttcttctacagtcccatcccaaggttaaactgcccagtgtgcaaccatctctgacctaggtcagcctgttccatgtcaagccattttttttgactataaaaaaattctcctttggactgcttccctgtggctttctcccacctaggtgacatcttgggcttacaaaaaaacaagatatttgaaaagaagggtcatgtttcccaaatcatctccaggataaatattttcatagattaggatggtctctccctgcttatgacatggtcccatgtccttcgaccatctcagtcttgctgggggccaatgactctcttaatggctttgttaggggataaatgcaaatttcccaggagccaccgatcagtatacaaggttgagagttcaccttccccacttggaatctttttactgctggtaggacagcttgagacttcaccatcatctatttaagtacttctagtgttaaaaaatgtgttaagaaggtagatcttgctgggcgcggtggctcacgcctgtaatcccaggacttcgggaggtcgaggcaggtgaattccttgagctcaggagtgcgagaccagcctgggcaacaaggtaaaaccctgtctctacgaaaaccacgaaaaaaaaattagctgggaatggtagtacgtacctgtagtcccagctacttgggaggctgagggaaacggatcacttgagcctaggaagttgaggctgcaggaagccagtatcatgccactgcactccagctgaacgacagagtgagactctgtctcagaaaaagagaggggcgagtatatctcatgttaagtattatcacaataaaataaaataaaataaaataaaatactcgagggttttcaaaccagactctgtctcccaactttgatgtgatttagtgaataactctacgtactctactaaataactgtactcatctgggtggccaagtataataatttttttgaaaaaaaaaaaaaacccaggcttattacgtagaaagtattgaatagcaagaagagccctgggccaggaattggaagctagatactctttctgtttttttccattcattttctatgtgagtttgacaaatcatttcctcctggagcccttgttttttattgtacaaaatgaacacgttggactggacatattctagtgtcccaattaaccctagaatctaagagtcccatcactttatatttctaactcatgcatttcccctgggttccactttctcttcgttgtagtggtccaagttgtcacgtgcttcctgtttgctatgttctaaaatcacatttctgaaaagtcaaacttgagttaagacattaggatgcttcagctgcctcttctagctttgtcttcagtctctttctcagcctgggatctgtctgggtgatctgcacttaacaaaactggggacagaaacaagtacggagttggcccctaatcaccccacctggtccatcagctgcacattcaaactgagaggggcccatttgctaactagtgggacattgctgatctgtaacaatgccgacagcctgccacgcctgccctgcctgcccctgaggagggcacattattcagctccttgcctcaattttagtgcccttcaacaatctgttttcttcattagccactgtctttttttggtggaggttggggggggtgcagtgacatcctattttccaggctgacagtccagccaagagtaaattagttacagtgtaaataaacctgggataacttcacagcttaaagtgcattaggggagcactggacattaatgccaggaagggaggggcaggtggatcctggtgttaatgccaagtaaggtcttttgctctggctctgtgtgttctgaaatctacatacagaagaattctaaagaatgccgagaagataagggcttctgccttcaatcttccaattatatgctagtccttggtaataaaaatgcttccaggatagcatctccatggggaccaggctttactgccccccaactccgacccccacatatcaagtggagatgtgcacagccatgaagatgaaaatccagccccgctgccctgatcatctggctttgaagtagctgaaacagctctcacagacaagtagactcttcagaggatatcagcccactctaatgctctgagttaactttaaacaattcacctcttctctgggtcccttcaattcccagggacaccatccagccccgtcctccctcttaaaaatggcagagcaccttggatggctgatttcaaacattctttgagagtctcagaaaaaggtgtttttaaaacaggaaggagctctcttctgcctcaggctcccacaccctcctgaaggacatgcttgaggcataagggtcacgctgccaccttgatctcaacttcaacctcagcccaacctgaacttagccagcctgcatcccagccatggaagctgctatttttgaaatagaaggaatattcaatacttttcactctgtcaatatttttaccttcatgtttctcctcttcccccacccctgtgcccctggttggggaaaaaaaaacacacatttttttaaaagctaaacaaaaacaaaaccccatccaggctgaggccagcagatcgcggtgttctgggtggattttgctacgtgccagcgaagaccatcagcaggatttgcaggaaacaccttgcggaatccactgggagaagccaggggccacagagaagcgtgaggcggatacactcacggtccatgtgactggctggctccccaggcctgggtacaggaaacaactgtgggattccagggccctgcagggacagacacacagtggtattgcgggggcgggggggtggccctgtggatccctctggtgttttccaacgagaattcctttaactcgcatatctattcccagctgcctgtgcatgacctgtgctgaggggacacaataagaaaggtcacaggcagcttcccaagagcttccgttccaggatttggctgaagctctgtttctgtgaaagaggggcacacagggcaaagacatgagcacttgggcaccagagaacctggggttgaatctcagctccagctcctcctagctatagactgtcgggcaaagcatgtaacttcttttcagcttgaaaagggagatgcaatcatacaaggctcataggatgttgcaggcattaagggagatactccccttgaggtacttagcacagtgcctggtgcaaagtaaccactcagtgaacagcagcggtgactactgttttgtgagaggccccctttcccaagacagtgaagaggctagagggcagcgggaaaaaggacgaaggggttccaagaagagagaaaagaaaatgcaaagtactagctgggacccatatgggccgtgcaagctcacagcagcctggctgccaaccttcctcctcctgaaatgtcggctgccccacttactcttgtttggagcatttcagtttcaggtcaggttgaagcgagggacattgactggtatcagtccaagtgcagtgaacaccccagagcaatgcagagagaggcccagcaagaggcaggaagaggaggcgtcactggaaaatgctcatttctcatttaagtctgtcagggtcgcatcttggtcccattctacccaagggtggggtgtagtttggttgggccaaaagtggtacgtcagagtgcatggtgaagcccgctgacaaaccttccttctggaggagctgtgggtgtgggaagccagcactgatgtgcagagtgagaaatgagagctatggagttggcaggcctgcctgggccagggtcagtgcccggggaccggcattgtcctggctggaggagggaacagccagtggccagcagtctgtgaagaggctggggtagaatgaaggccagacccaggccaattaaggtctgatgaaaatccgggccgtttttcacgaaacaggaggcgggcagccctgctgcggtggggatgctggctagatggagcatctggcaccgatcaattcccaggccaagaagtgagcctacatgtgggtgcaaatgaaatgccgaaggcccggggaccccaccccctctgtctttgccataatgaagtgccaactgggagccagctgggcaaaggggacatgttgccttgctccgtccactgtttggtaacaattacgagcattctttcagcaccaacaggaacagtaagctgggggagcaattctttgagccaccaggcgtgatcacgaaaggagggtttagatcaaagagggtatcagtaatgttcaacgcacctcatgggtctctggcctgggactaaagccggcaatgggatgggggagctgctaagaagtgccgagctgaattaagcagttcctctttcatctctgcccgtcttcttcagcggtaccctctgagggtagaaatggtgccagtttcagctggttccatgtgccaagttcaagtccgctatagggaggaggctggtagtctcctccaaccctcaagaccgctcctggggcagtggggaggtaaggaccaatgtacccaagatccttgttttttgtctttcccctcctcattgtggggccccctaatgagagaggaagagtgtgaatttccttatgtgactgtctcccccaagcttggctgatatactcttcagcccctactcccctccccaccgctggctccagcactgaatctgggaacgctcagtccagcgtgctgatgaggcaaacacagggaaggaaagagctcagtctcccagaaccggccaagaagtctatagtgggtaggtaagaactcccgctggattgggaaaccttggttctaactgcctggaccactaactcatgaggtagcatcaggcaggtcacttcctgtccctgggcctgtttccccaactgggaagcaaacagaccaaataaaggcccttaaagtctatgcatgggtatgccctgcctgtggcctagaaggctcatctagaagagtggaaaagacttatttcaattctgctccttctttcctgggtgcacagcacccagccagggattggatctctgacctttttctgaggctggctctaacacagcagccggcagatggcagaattttttagaggcctgtatctctgaaagatttgctacttcacatcaacataaaagaatgttgtcctaagaagctgtctgctcctaagtggccccgtaagaacttgccctcttgagtttcccccacttgaaggctggagcataagagctaagtttgaatccagcacagacactcactagctgggaaaccagggcaagacacttcacttgtctcagcctcaatttcctagctgtcaaaagggcattctttcctgcatttaacaaatgttagagtttcaagtatcttctagatggtgaacaagaccaacaaggtctctactctcctggtgcctaagtaacggaggaggaatcaggccaaacaataagacaaatacccaatatgatggcaggtgctaggaggcaaaggggaatagacaaggaggctggtaggaggggaagggaggcaaggaaggcctctctacgaaggtgacatttgagttgagacctccatgatgagaaggggccagccagtgagtatctgggggatgaggtgttcctggaagagaggacagcaagttcaaaagagacagtgacaaacttggagcctggagcatttgaggaatagctagaagtatgtggcaacagcaaggccaagggagacagaggccagatcccgtagaaacttctagagcttcttgaggaattaagaagccactggagggctttgagcagggcattggcagagatgtgactgacattttttaaagttcactgtctacttgttggagaaaggattgtaggggagtggcttgtaaaagcaagggagttcatgatagtcataaccacctctcccttgcccacccactctggggtcattgtaaagctcacatgagattcatgctgacacctagaaaagcccagaggtacgggaggaggtagatatcatcacatgttttaaaatccatttgtacaagtaggagcttgcagggactggcaccagggtatttggaactgtgttcctgtatagatttcaaggaaacggggtagggtggcagattctgcccagcctgagctatgcagctgtccaggcccaaatgaattcacatatttaaactgggagctttgctataggccacgcctggctctgtttttgctgctggtgccagacaggggtaagctaacacccagcaatgtggagaagctgacactccacgcaaagtcactcgctgaattcctggccaaagctcatctctcctgccctcactttcagaactgggaaggaaacagcaggagaggctggagatttattcactcggggatttttaacttcagagtgggcccctgcgaggtcaatgatcagcaaaactccagcattccagtgaacaaatctcagtgctcagagcagcagggattgaaagcatcttgggttccagcttgcttccttcagctggggtttggagctggaggcttggattcaaatcctgtctctgcctctaggttccctcaagtggaataagaagatcagtggcagcaggctcctagggttgtcacagggatcaagtgggagagcagaatgcaaaaaccctgcctaatgcctgccacatgcactcactcccccatgaactcctgagtggcaggcttgggactggatagtggacgccctggtgcctggtaaatgtttgcagaatctgaagacacgtagtacattttattccagctcaaataggctaactaagatgccaggaagttcagagaagagaatagtcaacaagatgacacatagtgaatatctagtttttttctttctttcttttaaagtgttaacttctcaagattctgcctgtcatctgtacaatgcagatactgaaatttcccaaaatttaacaaaataggaccgaggttatctggttttctactttctccatgctctttattttcttacattattacctttttaaattttgtttatttatttatttatttatttttgagacggagtttgctctgtctcccaagctatagtgcagtgacacaatctcagctcactgcaacctccgcctcccgggttcaagcgattctcctgcctcagcctcctgaatggctgggattataggtgtcaccaccacacccagctaattttttgtatttttagtagagatggagtttcaccatgttgaccagcctggtctcaaactcctgacctcaagtgatgctcctgcctcggcttcccaaagtgctggaattacaggcgtgagccaccacaccaggctcattatttcctttttaacttaagtaatacaacttcactaaagaaaggttgggaaaaaaagaagtcaacaaacaaacaaaaacctataaaataattgtgtaaatgacctaaactcccactgtccagttataactatgctttatatttatattaccttcaagacttttccctatgctactataaacttgtggatacgtcccctgctaatagaatcatccaaaatgtgcttggtgatctggtttatttcaatcccaatatatcagttcatatagctctgcctcatccctttgaatggctatgttgttttcaattgcatagatacagaaatgttagttggatgcttttataaacaactctatgataaacatccttgtgtgtttatatctgtacatgcacatatgtacaaataaatatgtattatatatataagcatacacacatacacacatcttttttttttttttttttttttttttttttttttttttttgagatggaaactcgctctgtcgcccaggctggagtgcagtggcatgatctcggctcactgcaacctctgccttgcgggttcaagtgattctctgcctcagcttcccgagtagctgggattacaggcgcccgccaccacacccagctaatttttgtatttttagtaaagacggggtttcaccatgttggccagactggtcttgagctcctgacctggtgatccacctgcctcagcctcacaaagtgctgggattacaggcgtgagccaccgtgcctggctaacacatacacacatcttagcatacttacctgattatttcctctggatctagaagttctctcctctttctaaacctgccattttagtagtaactgaatccaagtcagcagatcttccgccagccatcagctggccaccctgcagacctctacatgcagcattcagtataactaaggaagccctagacacagtttctcagttcccacgagctcacccatccctcccccaagtcctcccacccactgcccctgtccctacccctagaggccagctgtttaccaaacccgaaagaaatcctatctgcctgagtcctgtcccttttctgcgctcattggacccagcctgcgatttcaaagttccagggtctgagtagatatcccaagacaggcggggccaggaagagcctaatcgtttatgtcataaagtcactgctcaaagccgcctccccaaacaaggtccctttctgccttctgtgtgctccttttcttataaaagtactctggttgtcatgggcaatcagtattctgcaagagtagggagcatctcttttggtcagagagtgaatgcaaactgccatgtctttactcagtatcaaagacatctgcctcaaacactggttcagaagcgaaagaacaacatcgaaagcagaggaaatggatccaaatgtttcctatgaagggagtcatcataacaacccattcaacgaatacaagtaacttccttttatttgtatacagagaatttatatcatacatgcatgcctctaaccagcctgagttcaatgacatatatatattatttaattatgcaaaaaatatatacatatatacactccattttaaaagggcaattcctcccacccctgattcttcagtgagctccagacagggatctgctgttgtctctggtggtgccagtccctatatgactacggggtttaaagacagatcctgagattgtctcactccctaaaagcatctcagctgctcaacctgagggtacttgacaacaaaaaaaaaatagtaatctgtcacaacactgatggaactgctggctcaggtggagttatggagagatggcactgtatttttttttttttttgagatggagtcttgctctgtcgcccaggctggagtgcagtggcgaggtgtcgtctcactgcaacctccacctcccaagtttaagtgattatcctgcctcagcctcccaagtagctgggacttcagatgtgcgccaccacacctggttaattttttgtatttttagtagagatggggtttcaccgtgttagccaggatggtctcgatctcctgacctcatgatccgccacccttggcctcccaaaatgctgggattacaggcgtgagtcaccgcgcctggcctgcactgtattttacaggaatgtaagggttttttgactttctatgtgctgacttcataagatgtcactccatgacccttagacatataggtgtcaaaagaccttcacctataatcacctgtggcagggcactgtggggatgtaccatcttataggagtggacatggggctctggaggcagagtgacttgcctgagaccacatggatggctggggagttcattctgactgcaccccacgtcttttcactccaagtctggagctgcctcccctgctcctacacggcctattattagcaccatgggagcccaccaagcttcttcctgcctcagccagttaccatgctgtctgtccagagacctgcactcacggccccctaagttgctcttggcaatgcttctccttccctccaattgctattcctgctggtggctgctcacccaatcccagaccaccaccctccaggcctggtcggctctgtgctaatccactggaccctggctgctttggggctgggacacagacggcccactgcatcctggtttctgagaggagactccctttggccagccccaggttcaaatctagctcatctatttaagagaggcagaggacatccaccccactcacagctcccaacagaaacatcccttgcggcattctctgtggcaggtcccatctcctgcagggaccttggagagagaggatttccagcgtcaggtccgtaagagcaatcaggtaactgaccacgggacttacaagtcccaccaggagccagaaggtggcgcctaggaaagggatgggctgtgctggcttcctacatgatgctctagacccaaaagcaagggtcacttgagtccttgctttcccaccattgttcttttatctgattatcaaatgatgtgtcaatgtagtgaaattttattttccagaaaacactggatcaaattaaaatcatccaaaatcccacagcgcagagtaactagtgttgatatttagtatacagacattcagactcttctctaagcatctggatgcacattcatctctctctctctgttttttttttgttgttgttgttgttgttgtttttaacaaattggcttctgttactcaaaagtgcaccatagggctattctggcatcaatagagaactacctcaacatcttttatgactctttcattcacctttctttggaccatccattatattaataaatccatttctatcaactctggctatgagggccacacccacctcctttgacttctgattttaatagcacagcactgatgacaccttagcggttagcagaagaggaagtgcagatcttcactgtatgaacgcaccataatctaagcagtctatttgcaatagacatttagattaatttggggataaacaatgtagcaatggactccattgcctagttatttcttaggactaaatttctagaagtaagattgctagttaaagtgtatgcacatgtttgaggctttcgatgcacaggaacatacttccctccccagacgtcacaccagttgcctttcctcttagtggcctgtgaaggtgagagaccagactccatgaggataggaagtgcaagtcccagattccccacactgctctgccaagtccagggacatcatctggaaatccccagaggcatcagcacatggagcacatcccacgcagggcatgcaggggaaatgtgatcataccctgtgaacatacccagagacagcgaggaagactttgggcacaggagccagcctcggagatggggagttggggaaaggacagacagacagagctccaacttctttttttttttttttttttgagatggagttttgctcttgttgcccaggctggagtgcaatggtgcgatctcggctcattgcaacctctgcctcccaggttcaagcaattctcctgcctcagcctcccgagtagctgggattacaggcatgcgccaccacgcccggctaattttgtatttttagtagagatggggtttctccatgttggtcaggctggtctcgaactcccgacctcaggtgatccgcctgcctcggcctcccaaagtgctgagattacaggcgtgagccactgcgctcggcctcaacttcttacagaataatcagaagcagggagtggaaggcagtgagtgacgggggaaccatgaggccctctttgtcttgcaggaagtatccctccactgagtgggacatatggtgacaagaggagctacgtgggacagtgacaaatacctggttcaggaatccaccccctggaagctgctttcccccactccccacctgctgtgagatattgggaaagggcttcgcttctctgggcctccgctcttccatccgatttgccttgcccctcagctgagatcatcttaattctgtgatttcagaaccagcctgaagaccagggcagacaggtctccactccatccctgtctgttaaccaggtcattcacctttctatggaccatccattatattaataaatccatttctatcaactctggctatgagggccacacccaccttctttgacttctgattttaatagcacagcactgatgacaccttagcggttagcagaagagcaagtgcagatcttcaatggaacgtaaagaatgtgcttttcaaattcagcttcagctcagcctttactgaaagtccctgtcactgctggcatctctcacccacctgcattataaatggggtctttcccattttgcaattgggaaaaccaaggctcagagtttacattttagtcaactaactccagtggtaaaaggcagagacgggattccatctctgctttttttgactctaagttcatctcttttgacatcctccactgtctctccaaacccttcagaagagcctgggagattgcaccggtgggtattctttatgctcaaaaatataaattctctagtgcagggatgagatcatattgaaagagcatgaagccacctgggtttctcggattggtcatgcttggctcagagaccttgaagccaattaacatgtctctccctaccctttatcatccataaaataagcagtgagagaattaattagcaatatctggcaaactctgctctttatcattcatacatcacttctaatctaataagtaagcagttaacctccttttctccttccaagaacccacatctgttgacttggctttcaaataggtatgagtaagcttctgtgatccttcaccctaaaacatatcccaagccccaaacctccccttggtcccaggtgctccttggtgcctgggggtaatcaggtcctggtgatgccacgacttgttttctccgggcccctgcccaaccctaagcaagcatgttgcagaagcaagatgtgccaactaagcatgggtcaggacaaatctcagcctgaccctaaagactacctccatcctcaaagtaaatggggttaagggggaagaagtcaaccagccaggtgccggggagttacggctttcaggtgcaggttttccaggcccctaggtgatgctaggtgctgcagtggaatgggtggatgagcagaggaggatgacacacacacggagtagaacacaccacacacacacacacacacacacacgcagtggaatgggtggatgagcagaggatgacacacacacggagtagaacacacaccacacacaccacacacacacacacacacgcgcacgcacacacacacacacacacaggggagaaaggaggaatgctaaggaaatgccctgtgatcatgccctgagggagtgaggaagggcttgggcacaggagccagcctcagagacggcctgaataggatgagagggctgactctgctgagccaggaacgacacctacactccaccttcataggaatcagaaaagcacccactctcagtgttagaagcttgcaccaccccccacaccaaaaaatcccctcaaggccctgattcccttgggctctaaaacaaacaaaaaagctaatgggtttcccaggaagccatgtggtaggatggatatcacagaaaactatggttgcgagaacttcccttgggcccatgcgcagaacaggaagtcaggcagtgagtgggctcccaggaagttaatatacactatggacaggtagcaagttatggacagatagcaagatagccagttaatatactctatggatgacccagcaagtttgctgtttcagaatcctcctcttctgttttttgaactttcgaaaacaaaagatatgctgggagacgcggcccctagagtgtgcttactccaggtccttgattgtccagactgtggagggggaagggcagatctatgccaagaggggaacaggctgtagaggccacagctgattcatttttgtgaccttagcactctgcccagcacctggaatatagtaggtgctccataaacctgtgttcaaggagagaatctgtccatagcatatgtattaatgggacctttatagtcaatggacatccttagaaatcacatacccatcgttggctggtggttgagaaaaaaaggtaaaaaatgagatacacccttctacatgtttggcctccaatatggggccgggctgggcctcgagaaggagaccgcaggacctcaccagcaaggcatcgtgtcctctttgtgtcctgagatgccttctcactaagcctctttccagacctttggtcctggggatctgcagtgagcagagaggcagctccttgcgggtgaaacccagcaccggcctgcaaggccaagcctccccatgccaacacagcttatttcctctttcactacctcactccctagtggaaaaaacaagaaaacaaaattcccctgagcaatctgaaaccctgtgaccccctggccaagtggcagatccagctccaccttgatcccctccactttcctctggctcacctatacttaagcgcagaggccagcctcgaggttatttataactgtgtcagaggaggaggaggcaggaaataggaaattatgcaggagggggcgaggagtagctgcaggggccaagtgaccccgctggctggcttgaaatccactacctgcctggcccgtggcttcagagccccatgacagggaattcttacccagactggattcctcctggtctctgagccctacctgcgaatctcttgccagtcacttccccttctccagatccaggtggaagcagttttatcctgagactttccccctaggccggccacagtgacatcagcttttctgactgcagttaatggtgcaagagctggaggccaagcaggaggcccagcgccggaggggagacaaacacccagccctgggagcaaatggggtggcggcaaacacacggccttttaagtccaccagccctatccttctgtttcctttcctcctttaaatactctgaaagcgagagtctgaatagtgactacttgagaacccaagacttctccttaacttcatccagaggactcaaagggaaggccactcaaccagaatcacacagcagaaggagcagagccaggcctggggtcccattttctggaggcactggcccctttttctacactaccatgctgcccccagcccctgggctaactaagactcccccattctaaatgtgagtgcccctgatggaccgcataggctggatgtgcccgtccttgctttgcccagcagagccatgtccataaagatggcatcccacgtcaaatcctgtagactactgcaaaatatccatcagccaatttcttcaccaaaacgctctgagcagccactgaactggcagtgccattaattttcagacaatttcagactaagttaggttacctttttggggggattttgttgctgtttagtttcaacaccattattgactcagtgatactctagggcaagtgttctaatgatccaagatagcttttaggagaatttctgaagctcttgaaatttgtatgcatagctttaatcagaatcccaaaggtgctcctatcggtaaaatgattaggtaggacggtgatgtaagagaagtatagaacagagaggggagagatctggcccagacgaccaggggaccagggtggggttgcaccggtatgtcccctactgttcattacctgctcgcagggtgcctgccccatggaccttcaatcagaaacatctcaccttcacactcaccacaatgtccttcaatcatgtccttaacggtataaacaagatcctaggatttaaaaatctgatgtgtgcccagaactgagccaagcaagattataaaacaagtcatgaccacaggaaggaactttaaatctggcaaatgtgtgaccttgaaggtcagccttcccttcctcctttttcttctggtccctacaaagcacccactggcaccactacagccatttctgtttggcaaccctaggagagcagcttccctgtgtaatgcagatgatacttcctaatttcttcttccctactcagcaatcacaatggcaggcaagtgggcaaaaggggttttcagaatcctcatctgggcagtgtctcaccaactgcatttgtaggtgcttcttgggaaaattagttccttggctagatatgttcagagaacactggattaaacagagctaaacaggtcaccatgcagcaggacttctcagagcttttactatgctaatagccacatgtctctccaagaggggaatacaataaacagctctcccaaataacatttttttttttttgagatagagtcttgctctgtcaccctggctggagtgcagtggtacaatcatggctcactgcagcctcaacctcgtggactcaagcgattctcccacctaagcctcaagagtaactgggactacaggcccaaccaccttttcttttttttttttttaaattagtagagacagggaatcttactatgtgacccagactggtcttcaattcctgggctcaagcgatcctctcgcctcagcctcccaaggtggggttatatgcgtgagccgctgtgcccggctccaaagaacatttcttaagattggtggtgcaaggatcacaccttgagaaacactgatttaggccttcccacagtacaaagaaatgttgcctgccccatccttacagcacacctgatgacttacaagaggtgctgctgaattcctcccagggaagcgaccttaattcttctcagcaagacaaggaggcagccttcaggaaggacccaggagcttggtattagaggatgatccaagtctgatggcaaatttagagtgctccagggaacactgaagtcttgatgatagggcaaaagggagtgattccatctttctaacctggcaggatagcaggtaacaagacagaaataaggaaaaagcaagctgaacttgtctttccctgacatttgaactgcctgctgttctcctcaccaaaaataaaaaagctggtctcaagacaacaaaagtagagaagtaaaggtaacagaggtctccagcctgcaggaagactcatataacctcagtccaaagttctttttatacaaagcacagatttttactggctaagtgctcacccaatgacccattttcagtatttgtttattcctgtatttcacccatgtttatcgagcacctactgagtgtgtggcccgtagtcaggaatgcccatcaattaccaggcagcaaggctattcttagttttctgatgtctatttaaagagtgttaatcctctggcctcccccctacccccgcccctgcaattagacacataccactttccaacctggtacactgacctcgcccaactgggaaggcggaatggacaagtgttcttcccaccctgcttaacttggccaagaatctggcttcatgggttagggcagcctgggaaccagccaagccagaggagacgagcctgctttgcctgggcccttcaatcagtgctggggtcaaaaacctccctgttctgttccttactagtggcacagtaaggcagaaagtgttgagactcaagagcagaaaaatccaggctgtctagtggggcggtgaagaccacagaccacagaacagacacacctgctcaaatactagctctgccatcatgcagtggggtgaccgtgggcagaattggtgagattgctcggactctggagtcaggaggtccggctcaaatctggcttcactatgtaggtacatactaggtaagttacctagtctctctcagcttcagtattttcatctgcaaagtggaatgaggaggacaaggatgataacactaataatttctgacatgtatgtttatagtaaagaatagaatttattacatgtatatatgtatataaagatcttaaaatagctgtcaacaaatagtagctgctttcatatttaattcctcttaagtcccaatttttttcatctgcaaagtagaaataggagtgcctacctcaatgagtggttatgagagtttaaaggagataatgctttaaaaggtcttggcatataaaaacaaatcaataaatgttaaaatattatcaaatggttattatttttgttccagttccatctctatctcttaaaccaagctgctgtacctctttggacctcagtttccccatctgtcaagtgagagacctggatcagatggcttctccagtgtcaccgcacatgggttccctgcactgggacccacaaggcctagaagttacttgcagcaaagctgtcagtagcctctgagccttggtcagcccaaaagtacctcgaacagccccatatccctgtgcacagttcatgaaactagaaatggggaggggaagatgccttgcctttgcaaatgttatcttgacctgtgctgtagtattaacatggcggccactaaccacaggtagctgaaacgcaactagtccaaactgagatatgctatgagtgtaaaatacataatggatgtcaaaaacttaattttaaaaatattaagatcttattaataagtgtaaaattgattacatattgaaatggtcatattttatacatattgggtttagtattaaaattaatttcactttttcctcgtttttttaaacatgactatgggaaaattcaaaattgcatacatggctcacgtgtagccacaatcctgtttctcctgagcaatatcaatctagtttttttccctttctgtctccccgcttgtgagccacccagtaagaaactcttctcagagggataccagaaggaattcgaactatttgtaattaactttttgaaacaaaataaaatccagatgttaactatccaggtggagcattctattttagcagcctccaggaatctcctctggcttaaaggagccctgaataaataaaatctatccagctgccaaagcaccccatgatgttaccatatttatcagcacctgaagttctaaatctccactctggtcaagccatctcttgtctttctccgttagaaaaagatgggcagtggtttctgttttattttccaaggtacttgccactgtttaatacggtagcttagcagttaggaatggccttttctcattaagctcagctcccaatgtttcaaaccaatctctttctttctttctttctttctctctttctttctctttctttctttctttctttctgtctctctctctctctccttccttccttccctctctccctctctccctccctccctctttctttctttccttctttctttctttttttttctttctttcctttctttgttttctttctttctttctttctttcttttctttctttctctttctctctctctctctctctctctctcacacacacacacacacacacacacacacacacacgagtattgcctggaaaggctggaatgctgtctttctcaaatgttcttattcattcatgatacttttattgaatgcctactaacatcaggcaatgagctggtgagcaagacttggctcccatctaaggggaggcagtaataccatgtagtaataatatgatggctgacatttatcaggtccttactacatgccaggcaatgagccaggccttttatttccattgtgtctgtgaattcttccacaacctatgaggttaagagtactattattgcatactccattttacagataggaaaaatgagaccagggaattaacttgtccagggacaggcaactagccatgaacgaggccaaggtttgagccaagtggtctaactccagaacctgtgctccagctcagaaagtgtgggaaatgcaggacacattttgccaaaaaaaaaaaaattgggtgttactcactcagagatccgagaattgaaaggagattctagaaataaaatggattccagatcacaaaactggtgacccacaaggctgaatctggcccatggacatgttttgtttggtccacgtgtgtgtgtgtgtgtgtgtgtgtgtgtgtgtgtgtgtgtgtgtgtgtgtatcttttcagaagatgttacattaaaaatttggatttcttgcttgtcctaagagactggaaatctggcatcactagactcacatcctgataggctggagctggacagcagctgtcccctccagaagggacctggactgtacggttcaccacagttactgccactctctattgtctccccaactccaaagccaaagctcagatgctgtttatcatcacacttgcccactgttttattgcttgtcttataataaagaaatcatttttagtacctgtttagctctccaaaatggaaaccaagagaatggggaaccataaacatatttggtaggagtgagtaatattccaatatgtctgatactcaaatatccagcttctgtgcctggtccctgtaggcactgggtttgtgacatggcatggatgacaagtgaggaaatccaggccaaaagagaatcagccaaagaaggaactggaacccacacccaccttcccaccttaagtataagctttttatccactgcactcatttgttcagaactgcaccctggagaccaacctggattctgagattcttggatctctcagtccttgcagtggtgaagtttgaccttccaaacttcctcaggatctttggagctttctatcctgtcactggggtttctccctgtcaggggagcagatagtgactgcccaatggggcacacgtttgatctaagtcttccaaataccctcctcattcacttaaacaaaggttccatcagatcacacatgtgttcatctgagccagacttccatgagagaagtcctctcagcaacagaaaatgtttgagccgagccatgaaccacattttccagagtgaggcactgctcaggtaggctgtggataaggaaagccttattttgatgagtattgagtcttaatcccatttcttgtctatcagcttcttcagtggtgttaatgaggttcaatttttaccaagccctcccacaatcagtgacaggccctgaagtgaccttgagtcttaattctagccatcgactaagtctgcaaggttgctgtctgtttggcaaatcagccctgctccaacagaagtttggtggtcaaatatgtcatctgataaagtatctcagctcactagaggttttgttcagagcccgcatccacttttgcaaccacagaaatcctggctcttaccttaatagaccatatttctaacaaagttacctactgaagggtgtggttgacagatttaggtgctgagttattcagctaaagtagagagccctttccaagggaacttagagccagaaaaacttgaccatagtaggcattcagtgaaatacacaccacatagagccaatatcctgctgttttacagataagagaccaaacccagggaggtcagtatcaccaaggggactccagagtcagatgatgaactaggactagaccttaggcctcctaactccagccagtgctcctcctccatgccacactgcacctcctagccctggcagtggataggggagcggttgctgactcttcagccaagttcattgtcaccattccatttctagggccctctctttggctaccctagtgacttctacctctgcttatcaatgggagctgtctaaagagggaagggcagcaccagatccttgacaagtgttgggcttgccctcagaagacatgggttccaatcccattccatgtattggctatatggctaagccacagaaccccgccattctcaatactgacatccactaactaggaactatgaccgaccccccaatcaccatcctgctttcctcgttgcgaagttgtcatcaaatgagatcaaatggacttaagactctaaaatgtgaagagttgtgaaaatagagtaggaactttgttgtttctttctctgccctgtgggaagcactgtgacaaaatggaacacattagatttggaggcggggggatcaaaccacgattttgaattgaaactcagctctctctatatgaccctggaaaacatcacatcacaccacagagcgccattttcctcaccgaaagtgaagtgagaatatcagctctgctctataacaacactactactaaaagctcatgcttattcttattgagctattctgtgccaagaatcagtctcttgtatagactaagggctacaactttttagacttgggaagattctacccattttgcgacctctccacctgagtctttggctccccacttttggggcccccctcagtctgcttatctttgattttcttcctctccagacatgccttccctgctgcccccaaattttattaccgtatagtcagttctgggatcctaacataaccaagccttacctcctaacccagtgccctttcaactgtctcagtggttcccagccttttcaacactaaggaatatttagtgctaaacattccatgaagtatttcacttaattgccaatgaagttaccacgtggtacataatatatttccccccattttagagatgaggaaactgaggcaaagaacctgcccaagcttgggagtagcagagctcactagagctatcatgtttccaaatcgaaaaggcagggagcttattcatgatgataaagtctaagtcaaaagggagcccttcctaaatacatgagatgcaaacaccttagtcaaacacctcaagtcacgaaaccaagtcttcatgaaatctgaccctggttgcgaaactcaccatccccacatcctaatccaggcattgcaggagctctgaagtttctgaatgaaacagctcttctctgcaggcagccaggcggccctgtgcctgacaccctcatgggcagaggcagaggggataattaccatgtagtatttaagatctctagttccggaatggctcttggaggcttggtcagctcaggacttcccctctccactccccagtacccaccccccgcccaatcatctagggctctgtttttccactaactgaactttaccttgggctctctgaggccagatcgtacagctttccttcccttccccacccccacaaaaagccaggtggctgcaggcttggaaacacttatagtttcttgtctccaagccgtgaatgccaccattaggtgatcggatttacatgaacataaatcagacttgagtgttgggtagtgtggactgtcccttctgtgacagcaaagccatcctagccacacagatggcctctaaatgggtcaggaaaggttctctggggcccctctgaagctacaaacactaattttttaacagctgaacaaaaagacctcttagttccactgcagcccacatagacacctgtgggcctcctgtcaaacagtatttagtaagtccctttagctagaatcaatactttgtgtacccctggatgccagacatgaacataggaaaatatctgaacccatgtcacctcctctgaaaggatagggacctcaactaggacacatcagttacctgctgtctatcccaggcatggtggcagcactgtgggtaacagggagaagtgacaatggcagtaaatgcatgggacctgcccacagggagaagagatgctaagctggcatgaaactaaagattctcaggaggggcaaaggacagcgatataccaaagaagccaggagctattttaggcatatcagtaagccaacccaaatccgacaatgcaatcacccaggaacccatgagaaaacttcccaggcttatgaaaacaccaaccgtccttgctttcggctataattaattagtatattagctgattgtgtcagaataatgactggctagtatcagcagttctagttatattttaatttgttttttaatggaaagttaatcaacactcaacacatgaaattgtgtcggataactgttccaaacacagaacttattggagggaaaaattaattttaaaaaattccatagtgttgaaaagtctgggaaccactgagagagttgaaagggcactgggttaggaggtaaggcttggttatgttaggatcccagaactgactatacagtaataaaatttgggggcagcagggaaggcatgtctggagaggaagaaaaccaaagataagcagactgacggggaccccaacagtggggagccaaagactcatgtggagaggtcgcaaaatgggtagaatcttcccaagtctaaaaagttgtagcccttggtctatatgagagactgattggaaacacaggttttggagataggctaagcaagtataggttgcaagtggtgtgagcttgggcaagccatttggcttccctagcctgagacagctcatcaggcagctgggatgactgataggcaagtaaggagcttggtacagtgcctggcacatagtaagggcaccaaacttactatgaaaattacagtattatgtttgtgatctcctgcagggttggcatttagaaatctccactttcttctctgggagggtgctagggtatcatgtccaccagaagacaggactagacttatcaagtaatgcagagagcatagtgggtgcttaccctctaaagtgggttaggtttatccctctgggtggcacgcagccctaagttctttctcccagcgcaggaatgatcccctctgggagtttcccatgcagctttggagaatttgggttttactagagatggtgtttttcagcatgcttaaaatatgggcaaggtttatgactgttcgtctgtaccaatgccaaggagtgatcagggaaaggaaccaaaggagacctagagaatgagaagttaatgaggactgttcaaaaccgagggggtgtcatgggccaagagccagagagacagagtatgaacagctggagcaggacagaccagtgatgagactatgaggatgaggtaggcagggtccacactggcccttgtaaaagccatttgatgatactttatcctaagagtccactgaagagctttcatcagaacaggaattctttcctaaaccaggccttctagctcccataataatgagaccccagcgtccttcttggctggggtccacccagcctccctctcggcagtccatcctcctccttgtgaccatcccactgctctcacccaagtgccatccataggcaacaagaagggagacagatgagtgagtgcccttgctgccaccatgagcctggccagcggacagctttgagtcagaaagcaaaaccctgtgtatgtgtgttcaaaacacagccacatatacctttgaacctgagtccatgtaagtcctcaaagtcaaacaacttggtgtaataaatggtccactgcttattctgaaagcaaaataaatacataaagctatcttcaaccgaattactccagcatgcaacaagtcaagggtcacagctttcctggcattgcagccttcctctccctatgaaaatactcccattaacttgatcttcgtggccctaattttgctccctttcaaagagacaaaaagaaggaaaaaaaacactcagtaagtcaataaaaattataaattgtttttctatttgagagaagcatgggagtctcttaagcacagggctctaacattcctccatcccctcatgttgcatatatgaaaagaactgtgttaacacagccactgtggaggccaaattggcaggaactattaaaattgaaaatgcatattatataattataataatataagagtatgtagtagtatatataatatgatatggtataatgtgacctatagtatagttgttaaatatattttagagccagggtgaaggggcttaaatacaggctgtattccttgctagcagtataaccttaaacgagttacctcatttttctaagcctcagtttcctcagctgtaaaatggagatgacaatagcacacctccctcataaaactgagagaattaaatgagttaatgtaagttaatgacttagaataatgcctggcacatagtaatcactctatacttattagctgtttaaaattataacctcatgaaatacataaaagaaatatatatattatatatataatatatatgtaaatataatatatatatattatatataatatatattatatataatatatattatatattatatatttatatattatatataaattatatatttatatattatatatttatatatatatatcctccaaaccatcaatccacagtaataaaaggacttggtttgtctcactgtggccagggagaagtaaagttaatagagacaagacatttcaaggttccaagactcttcccttaaaggtggggatgagttaggggtccccagggggagctacccagtctgccaatgtggtgggaggaaagccaggggggcagtcaggagactgggtcccagctggagaaggtgctcctctgacagttttatatatatattaagtagaaagatctctagtacgcattgttgaatgggaaacaagcagaatactatatgtggtattatgtggtattccatgatgtttaatgttctactattcatgtttctaagggaaaaactactataaatttgctatggatacctatgtatgtaaatgtataggaagaaaaggatttggagaagggactagagttagaaaaagtaatcagaaaggattttactcttctccgattttagatagagagatagatagatagatgataaatgataaatagaaatggatatatcatagatatacagagagatacatacatggacatagaatgtattcatatacttgtagcttttaaaatatagataaaacaggccaagatggtacaaattgttattccccttgtataaataagaaaactaaagctcaaaggtagcccatatgtgcctaggcacacacagccaacaagccccagaggaaggagtggagctcagatctgccctccccattgcctttccaccactccaccctgcctctcaaggccacccaggagtagactatgacaaaaggtagaagaaggggcctccttgtccatactggctggaatggtaaaagccaagtgcgatggagaatcgtgttgttgtttttgtttttaattaatgaacctgttggaatgtgccattcagcagtggagctgaatggttcctgctgttcatgcaaaacaaacaaaaatccctccacccaagctacttctgtggccacttttctagccttatctatccagggactgtgaaagggacacagaactgtcagaggggcaccttctccagctgggacccagtctcctgactccccctggctttcctcctaccacactggcagaccgggtacctcccactggggagccctaactgatcccacctttaagggaagagtcttgaagccctgaaatgtcttgtctctattaaccttacttctccttgggccacagtgagacaaaccaagtccttttattactgtggcttgatggtttcaagggtcttttccagatctaatagccaaagaacattagaattttcctctatgatacactagaataataataagctctccctccctaaagatgatgtttaattaaaacctctggccattttggctatcttcatatttttaaagaaaacccagatgtagaagaaaagcattcttcaaatgttaaccatccattccatctcctggtcaccttagaatgtcatgtgtcaatgaaagttgaaaggtttttgaagcatggtataactgataatacgttttagctttatcatttagcaactgggtggccttggacaagcacagtctcttcagcctcagtgttttccatctgaaaaatgggtgcaatacctactcttaaggttgctgtggggggtcgggggagggggtgaaagagatggcatttgggaagtgcgtgcaaccaggaggggcctaagacatgtctcttccctcctccagctggatagcagctctcctccttccatggttccaagacatccacagcctgggtcccccagacttgccctaccaagtgctggcgcctctccaaagtctgattctttctattttccttaagttgcaaagcccagtgttgaggtgtaattgtgtgtaagagggagaggggatggatctggtttctttgaaaatggcttctttgctaaaacgacaacctcagatctgatactgaaagaatctgctggcactggcccctgtcagaacaatttggagctatccaggggccatcctctggggctggcagccggccccccagctgagcctcatgctcaaattcccaacaggctcagaggcaggccccgaacacacttcatcctacagccccattcctcccatgcaaaggcggcaagagagaaggagagaagggcttggcattctgaagcaaaattctctttctctgctgcaacccccctcagccctgccagccacctttgcagaagccacacacgcgcacacacacacacacgcacacacgcacattttcagaaagcccttggcacagcccaccccttcctgagctggacagagctgccagggcagatttgcccgggccgaggccgccttcttcatctccagccccctcccattcctcttctagagtcaaggttttgtcaggagtttcaggggcaatgactggccagggagggggaccacagacatcctgcctgctgccaagtccctttctttcccccacagtgtgtcttataagccggcatgtagtttattcttctcctaaacacttccatagggtgcagggcctggagttgccatagaaacaccttttaactcctcctcccccagaatgccatgccaggccctaggactttggggaaaaaagacaaaaagagacacctgtggatgagcagagacaggaggaaaggccatcgggcagccccccggagaggaccaggccaggcctcctgtgccttttgctaggccaacatggcaccaagccatgaagagaaaaccaccatgatggttttaaaacaggaagttgatgggctgatgtgaacacctttagggggctacaaagttgactggtggggttgtgtgggtcccaaggaatggggagctccttcatatttgtttgagggcgagaatagacagtttcaacccagactggaaaccagaaaggctctgagcaatgaaacttgggagccaagtactggacgccagcagggtgctgtgcaaggcgagggaggtcggcaggcaagcagctcacacccacacctcccattttaaaagcattagctcatccctgccactagtgcagctcaccaaacccaggcagaacaatttgggatccgtgccagagcatcgaagattttttgtttctttttttctttttgattccacaatctcctggtctttggctacttcctggtaacttagattttctctgagaaatttatgaagaggagcgagggagctatttcttgtttcaatccagagaaattgtaagaaactttctgcattgctcagacccaccgcaggaaacctaagcagtaagcagacgggaaggcccccattggaagcaggatctactcatgcttgttttcacttttccgtggtcaatttttagggtagaaaccccaaagcaaagggcaagggggaagaatggggacctactcccactacataccaaaaaaacgcaagtgaagtcacccagcccattttccagcagaaaaggacttgggctgcacccctgcacaccctgattccacctgccagcctcctggccgcacgtgtgtgatcctgctgggcaaaaccagaactcagctgcagcagcaactccccacactaatcaggtgggaatgttaccaactgggatgaggagggaaagggtaagtggaatgtgggtggaggtggaggagggaggaaaaccctccccagtcttcaggctgcccaaaaggatctttctaagcaatccacaaatcctgggccagctgggttcccccaggagaggggaggatgtaccatgcaggccccagggagcctcttacaagggtgacctcaggtcacacaaacaccctcagctgccaactgcactgacattctggtcaccacacccccactctgacctctaggctcagcccagcccaccagcagtgcccctcccggccctcactgcctcccctgccaagctcctacctcctccccctcctcaccacaacacgctggtagagtccctcacccaagactcagtggaaaatttccttctcctttatgactgtacttaaaacacacacgctccattcttcacctctgaatcgacacaggcagagggcggcaaggctgtcccaccccaccgcccagcccagcccagtgcacacacacacactctcccagcagagccactggacttgcacgctttatgggctggaaaggaggagagagatgtttcccagatgccactccacctttagccatccaaacacaagtgtcccaaacactcccagacaagcctcccaggatgctctcggggccctccatacacactaaggagtaggaggtctctttacagggtctctctactcaagacactaagtccagtctggaactgtcaccgtgatgtgacccttggcaggtttgttcttttggtgacaaatctgttttccactacccattctccccctccccacacacattcaagggggaaaaaaatagccttcctgtgaattttcacagctatgtggtgagtgacccctcgcaccttctgctggctatcaacactctcaaacacagtgcctccagggcgtgggtcaatgccacagctttctcctcattttcccccttaaatccacccaaacttggcagtcccagaagctcggttagcgcttgcctgggaagcctgcagctgggttgggtctcagtgaaaagaatgaatttcataggcgcaggagatgatgcagactcggagtactccaagtttctcctgcaactttccgtgcacatggcgggcaacttttttttttttttttaactattcaatttcccagcactttagttagcattccaagttttgggaaccctttccccacccttctcttctagcccttcctccgttagtagtgaatggggacattttccagatgtcaaaaggaccggtaggaacctcacgacctaagttaggaaagcaaaggcggccaggggctccctcagccactgtgagtttcctctgcagggcatcttcccctctcagctatgccagcgcccccgcccaaggacatcgagtttctccactccgccccaaccccgtctgcccctctcctggggcagaggaaaggagtggggctcgccctgcctccctaagcagcgctgcagtcctggctgcagcgtggggctcgggcggggcaccaggagcgcttaccgatgtcggagttgcagaaggcgtcctgggggtggctgggcgagcatgtgcacgcctcggcgccccagtcccccaggctccagctgcccaggagcacgatgagcccgagccaaggggtcattgccgctgctgccgccgctgccggggctgctgctcgcctctccaaagttgccgtgcgcgccgccggcggggctgctgcagcccgagctcgctcgcccgccgggccgtgcggggcaaccttggcctccggcgcgctgccctccgagtgcccggcgggacgggatggggcgcagcgaggctgcctcggcgctggcgcaggactcggcgggcggcctcccggcgaaggagcaggagctggaggagcaagaggaggaggagaagccgtctgagcgcccgccgcctgcctgctgcccgctctgcgccgctgcctgggcggccgagtgatatagcgctgggcccccggggaccccgcctcgggctgttggggcccgccccctcagaccaatggcagagccgcattacctcatcggccctccaaaaagggggcggggccgggggcaaggggtaacggggcggggccgcccccggatcgttcagatccttatagggaataatgccgccgtgggcacgcgagtgggtgggctggggcgcgcccgggaccggtgcttgccgctgggtcctcggagcggagccctcgtgccccttctcgtctgcgccctggccccacgcccacctgggccactgggtgtctctgacccaaaccagaaccaactaacacccacccaccccagcaggaccgcttccacaggtgaggggtggccatgtcctagagaccttgactgtgcttggtggaaccagcgggggaatgctaactgctacccctccagtttctctggagagagcaggcacagaggagaaagacccaaactctctctctttctctctctctctggttcttactctctgggatatgggaagccatctgctgtttgcagctggctatgatatatgatagaagactgttttctgtgctctcccagagcaaacggggttctgtattcattcaacaaacacggttcaggatgctgggttaagcaacacaaagcccttgcccccgtggacatccatgaatgcacagggtgattttctgtgatgctagggctatgaagaaaacaaaacagagttctgggttggacatgactggggagggcctgctctctctgcgatagtaagggaagggctccctgaagtgccatcctcgctgagaagtggacaaagacaaggatcagctctggggcaagccacaggagagaggtaccaggcagggggaacagcaagtgcaaagaccctgggcatgtttgaaagacagaaagtagaaaggcaagaggaagtggttccctgcccatggctgacagagctccacccttcagcaagggatttgggggtgagctgatccaaaactgtagtaaaaccaggagaacgatccaggatcctagacgactagctataatagatgattgcagataactaacacaattactatccttattattgacatcttgattctgctttgtatttttaaaagcaggattctgtatctcaccgtattatagctctcacaataatctttgtgggtaggaaaagcaagcacaagtatcactcccactttccagatgaggaaccggcacagaaagatgggatgattggtggccagccaggaactcgtcacccctttccactgctccttcccatctgaagagagacatgcatttccctgaacgtcagcagctgttccatctaactgcaaatggccatttgcagctgggatcttccatctttctacacttttgtctctttccctttctcttccgcttcatcctgttagaaatgccacaagtttggaacaaatagaaacagggagaaatgcaagttcagcttctttctcagaactcctctgtttacatctcagacaagtgacattgggacagcagaggccgaagaattcgtgagagatggtatttccaagaacatttttgaaactcctttttcccctttgagcactttagccataggaaagggaaaccagtttccacatctttttgacttgtcccctccacccagctttaaaaaccttccctgccttcactctaactgtggcctaactcgtagagatgtttctgtctctcgatgtttttctagcactgttttcattgttttatggggtatgattctattgcttccccaaccacagtaggaatactttgaggcctgggatatttagccacactgctttttagccctctcagaaccaaatagggtctcaggagactggagagcatgggtgtggccaacagctgactgagtcctgagcagagtgccctggaggccactctaaggatccaggttgaatgagggcatacgtggtggaatttgagagattcgcttatccccgcgccccacatgacttattccacagtcatgtggaaggttttagaagactttccagaccaaatccactttggataagcatcttacatgatagaggccctctcttccctttcttttcacatttcagttttgtccaaagtgccgatattttctccaacggaaggccttgcctggaatataagtatcaagtagataacttctgctgaacttcaagcagcagttttctcatagaaagcatctgaagcgtttttttccagcagctacttaattatgaaagcacaagtataatctgatcttttttccagctgaaaagtaacgaaattaccttttggttaatttcttctcactccctatcctaagctggtccacacagtgtcttgaagttcagcgaattccaagagcttttcagttgggatgttctctcttattccaaacctgagtcagttcccctctgcccaccgtgtgaaggcagtttggttctcaccctaaggaaaagaaacagcaaactccatgaatccttgcgtaggggagtcctcctgctagggtcacccccttcagcaggcacccatcagtctggatgtcatggtgtccatgagcctaataatatgtaagaattggttattcaacatcacttaataagctaggtggggtgaacctgaggctaacagtaagaatgaagatgcaggctgggtgcggtggctcacgcctgtaatcccagcactttgagaggccaaggtgggcggatcacgaggtcaggagatcgagaccatcctggctaacatggtgaaaccccgtctgtactaacaacacaaaaaattagccaggtgtggtggtgggcgcctgtagtcccagttacttgggaggctgaggcaggagaatggcgtgaacctgggaggcggagcttgcagtgagctgagatcatgccactgcactctagcctaggtgatggagtgagactccgtctccaaaaaaaaaaaaaaaaaaaaaaagaatgaagatgcaggctctcctgctttctcttgacagctaagaacaatgatagagttatacatctgggaagaactgagtaagtttcaagatctatctggcctgtctacacacctactaggatgacctggtattctctttcctggaacttttctaggaaaggtgagttcatatccaccctctttgtatcaagttataggatgctagagtctgtaggaagagaagtcgtaaaaaggacctcagaaactactcatccttgttttaaatgtgggaaaaataaggttcagagaagtgaaggaacttgcccattttcagggctcagtcctccaagctgtaaggtgtggcccatgcttgtactgtgggcttggaaaccccagccattcacagatctcgtatctgcttttcagatctgtagacagattcgtttgagtctttgtacagtgcccagcccacagagaaattttacttacactgattaaataattctctaccatgataataatcaccctctgagccaatcagaagcaatacaggtttgtcctcctgacaggtttatctcttgtgtgtttatttttttcccttcctaaattactagctaatgcattccaaacatatcactataaaaaaaagcacatgaaaactttgtttctgggaaatgaaaagagagtaaagtggaaacaaaaaatcaaaagacctgagatttgttcccaatgttgcagaatagctgtgcacctgccttggtcaagtcactttgcctgtccaggcgtccacttctgtgtttattggatgaaagatagaactcagtggtatccaggatccctctcgcctcaaaaactccaagattccatggggaatcctgtaggacaagtgaatgcttctgaaggggagatgggtcctgccatttaaacaggtttgacacatgggaacgtacccaagactgaagaccatccatcagtttcgcaacgaacactgagttcctatattgctacctcccccaagaatcaatgccgaaaacagaatttcagagaagattgtgatgccaaagtcctaggagagacaggctctggcttatggtggagcccagtgtagttatgcgttcacctgcttgtttgtctcttggatcgtagcactaaaaagttaggaaggtgtcttttttatcaccatttttttggtcttcaggagttactgaactcttccacatccttcagacctcagcttagatgtcacctcctccgggaaacctcctctgattcccctcccatgtatccccacaacaccctgtatcaacttctttgacaatacttagctgactctaatgtgattatttacccatctgtttcccttgctggagtctaagcccctagaacacagggattaagtgttggtaacaacgagtttaataagtattggttgaatgggtccaatgatcagcaccaccgacccctttccagcattcagacaggcaggtggtggctccttggagagttcacggagctctatcccgctggctggtgctagggggcgctataagccagagaacacccatttgctcagcctgcagtcctggtcggtcgtctcactgcgagggcgggagagcacaattccacactcatcggtggggtgcgggtgcctttgagtgggtgaagctcacccctcccatctgccatggccacaaagctctcagtcaacatcccgtctgggttcgtggctgccggagctcctccacccctgagctggccacatgtcaaccaaagggggagatgctctctggggaagcaacatagttgtgaatcattggtttgggggccttagggcggtctgggaacactgcagaggatgccacagtcccagtcttccagggcagagctgggttttggaaattcaacctggagaaggtactgtcatttctgttgcctcatagggaagctcctctttgctttcctccctcttcccctccagaccctagccacgatgccttcccccaagccccaccgtccatgtgaaagtcattatattcaaaatggccttttccaagcaacagacagcctggtccacccatccccatgagctctggccagaccctcagtggggctgctgcccagcactgggcaattctgagcctaagatgcgaggtactgcaggatctctctgtgtctggcaccagcagggggtaaacacctttccttgcctccatctggagccaatttcatggcagtaaaattgccccagctctcccccagctctgccagcaaattgaagacccctctggctacattcgcctctggctacattcgcatgaatcctcaggttttcatatttctttccacagggatctactctcagtgtttttaagccagaaaacacatgtgtgcagtaaagccatgttgtatcctgtgttatctagggtggtgggaaatggaaagcagagtcaaatattccagctcttgttttcatgtgcatgtatgtgtgtgtatgtatgtttcaatgaccatatattcaagcagtcaattatttctgtgaagggtactatgaaatggaaggagaagaacttctccccaaccctgttttaatgtcttccttatgcccgtggagttcatgtgtttttcctttaaaaacgagtagctcctttgtggtttctttgaaggttgcatgctcagcttcacacagagaatacacacaagcatctcagccaggtgctgtcatgccttgggagggaatgggatggacatgtggttggtctcctgttagactgggctggaggtcttgtttctgcaaggcacatgagctttcttcagtggaacctgctggaactgatatggtcttgtcctgtgctgtggggacagtccaaagagcagttaacaccattgatcgcatccttctttaaacttggctgctgagaccctactctctctgggattctgctttctacctctccatctataccttctcagtcttcttggcagactcctcaggttcttcctgaaattaaaatgtagctgtttcccaattttctgtccttggctctctccccttcccttttagcctccacactctcccaggcctaccccacgcacccccatggtcgctaccatgctatgtgcaccggagtgcacactgcaagcaacagtgtccctctgattgcctgtcttctatctccaacttcctcctgcccaatttcacctagagatcctatggcctcctcggactccaggtgtccaaaactcattgtcttttcccctcagtcccctccggggttacccattccgaaggatgacatcatcactcaccaggtcctatagagtctcatgatccacatctcttctaaccatcccttcctctcattcttaccatttctaccttggatcaggcccctgtggattctttcctgacaatttcaatagtgacataattggttacactccccagagtctttctctatcaacttcaactttgcattgctgcttctgtacattttttaaaatataaatctgaaaacatgctattctttgcttgaaatgattcacttgtgctccgtggctttctgaacaaagtcttaagctccaaagacaaacaaggccctctgtgatctggctcatccccagggccccacggtccacagctggaggaggccctcttcacatagaatacaatgagatggctgcccctgcagttatacaacagcaggctctgttcttgcttatctctctaaacccatgctgccctcttccaaccctttatattccagctatcggtttctctgagccttgttcacaatgcactcttggcctggaatctagccgccaccaatatattcccccaccctcctccacctcatctgccaggaatcacgtattcatctttcaggattcagctagagtcaccacttagtgaatattttccggtcctctctctgccccagcagaatggaccaccccctctcaggcctctcctcttctctcactcacctcccacccacactgggtcctccgggcttccagcttggcacctcgcacactctgttgcccctagtggttgatatccctggttctcttctagatatcgagcaaatccaggtgcttctgtgactgcctaacacatcatatgcacatagtagacattgaacaaatattaaaggaataaactaaccaatgaatggagtggagaaaaggaggagtcagagtatcaccgtcacacattcaccccaacagaggttctggaatccagctccttgggtccagaaactcaactagatgaggctccctcagttgatcattctcacggactgatcctaagagctcagcaaaccaaccaaaatcccactgggcttgtttcccgtgaggtatttcattgtcacataggctagaggactcatgtcaacaccacccccatattttcctcctgatagtcacagagagcttcaatatgaagctagtttctcctcagaaggttgctgtggtgtgtgtagattcagaatacagggattgagggcatcataggaagggtctttcagctgagataccctggaattctccttttcatggaagcaaaagctttgctgaggaaattccagtgctcacaaccactggccaaagcctctcttcctgaacagggacaatgctggacacacaaatgccaactgcaggctcttggatcttcttggttctcagcaccaggctggccactccatccttctcttccccaacactttctttgcacttggaatattggaattcatttggcttctacattttagtatacaagtcaccattcaaagattacccccaggtcaactagtttgggctctggtattcccagattttcaactctgcccttgctgtgtcttgatttattaccacagatggctaagcacaagcatggtgcatgaatgtatggcttcagtaagacagatgaccttgtttccaagttctgggtgtgtgcttaatcatgaattctccactgacattctccatttgcctcacatcttatgtgtcatagtgtgatgatcaagtgtttggaggataggggcagggtcctctccttccttccctccttccttcaaatattcaccaaacattggcagaatgtctgttactccatgctaggccctgaagatacaacagtgaacaaggcatagaactgttcccaaggagctcccagtcttctgggagaaaaacacaagaaaataatagttggtggaaagaactacagtgggatagtcaagtgtgccatgagatcatagagctacctatccaaccaggcagcagggagttgtttaggaactcagattatggtaagacacaaggtcagaagtaggagagagctgtgggttaccaagttgaactccctcattttacagatacagaaacaggcctagagaggtagacaccagattattggcagaagcaaacaaagaatcagactccttagtacctcatcatcttcccgtcactccaggctgctctaattcaggctgggcccatgagagataatcaataaataatcatctccctgctctgcaactcgtcaaccttggaatgataagctgaaaaatgtttctaagatgagtaaaagagaagggaacttggcattagttgaatacctactatgtacaaggcactttcaatgcagtagtcccactaatcctcacaacccttaataataggtactaggtactatggtattatgcccattttatggtcaaggaaacggaggctcaaagaagttaaattgcatgttcaatttcttacactcaaggaagtggcagagctgtgattcagatgcaggggtctctttccaaaccagcactcttcctgaagacttcaaagtcaatgtgcccacacgttcattggggcatttgcagcactggtgattttctctttgtctcttgggttctcgttgagtgctcagagctcttgatgcagccaagcagagaaaagcatagtacctacctctgacgaccagggagagagctttatctgcaggcaagtgagatgcatctctgtttcatttggtttgcaatggagagaaggcaggagaagtgacttggcaggcaatttctaggggtgcgggtgtgcccttccttactcaaaattttgatagatgccataggaaatttacattcgtattacgtagatagggcccagaaccagaggcaagctggtggcatactcatcagtatattttaacagctaatgaacctggcttcatttcctcctgaaatttcaaacatgagattgaggcaatataccaggttattatcctagtcctaccacataaaatagctgtgtgaccttgagtaaatcagtgactcctttctttaaatgtaaaaccaagtgggttggatttaacgatctctcaaaatttcccatggaatattctagaaggcagcccaacagggaggttaggaaccaacgaaggcctgtgatgtcataagtctgagttttatccttctttgctttttcactgtgaccttgaacaagttccttaacctctctctgagcctcagctgtctcgtgctaaaagggaggagagatgcatacctcgtaggattttcatgaagatcaaacactgtaagctgaataagatgcatggcacagtgcctggcacatagtaaattctcactgaggactgtgtataccagggtgtggccccaggggtataaaggtgaatgagaacagcccctgccctcaagtagcctatagtctagtgacctgtgtttataaagaaagagcatgtgcttatatcccctttgaccttgtaattaatactcaaagaagggatggaagaaaggaggcaaaagagaataaaaaaatttgatagtcataactaattcctatagagtgcctactgggtaccaggtattcttctaggcagtttgcatatattaatttgtaccagttcttatagcaaaagccatgaggtagatgagatcatcgttgccatcccttttcacatccgcagtgaaaactaaggtacacagagattatgtcacttactcaagattacatcgccagtatgctgccgtgctggaattggaagccagagcccatcctcttaactaccccaccactctgcctcttcaagcagaaggcgagcgtttggaaaataagaagggatgcaaaggtcagatgcccagttcctgaaaccagatgggtctttcttcccagaatgcctgtacccgccaatcaagggtgaggagccattaattagatatggcccctatcagaagtgacacttagtagggcattgagtttgtcggcagcccctcttggagaacagtactcagccaggtcaatatgccttccagcccttgaggtaagcaccgaagttagaatcagaacatttgagtcctatctcctccagcctcctgcattgctctctaagcgtaaattgaatccctataaagcgaaggcaaacatctaattcacagaggcagctgcaaagatcaaacaataagtaactaacatttactgagcgctgctatgtgccaggtcctattctatgtaatatacaagtgtaaaggtatgtaattcacacaactctatgatgtaggggctgttatgatcatgcccattttatggaaaagaacactggggcacagagacgtttagtaatgtagccaaggttacacagttaatctgtggtggagatttccaagttcagcgtcccatcctgcactcctcactatctctgaatactctagtgatcagttaaaaagattttgtgaacactaaatgtgattgtgtttcttttctccggtagtcacatcttaggtctttgttcattccgttcccttgaccttttctcgtagctactattacttgtctgcgatggtgaagagcaaggttctagagaccccagtgctgcactggagctggctcaccctggcttgtcagagcctattgttatacattcgggaatttgcaggtcggtcattaaacataggcgttatttaaaattttggctgggcacagtagctcacacctgtaatcccatcactttgagaggccgaggcaggcgaatcacttgatgccaggagtttgagaccagcctggccaacatggcgaaaccccgtctctactaaaaatacaaaaaattagccaagcttggtagcacgtgcctgtagtcccagctacttgggaggctgaggcataagaattgcttgaacccaggaggtggaggttgcagtgagccaagatcatgccactgcactccatcctgggcaacaaagcgagactccgtctcaataataaataaataaataaataaataaataaataaagtttaatttaattatataatgttataactaataaattatattaatgaacacttgaaactcctcactccttaattgtttattacagtatactcttatttatgctttcagggtaactttcatctgttgtttctgtatggtggaaatattatataatgatgtgctactgcatttaggaacattaccttggtaacttaaaattggctatgatggaagtatttacaccacagaaattggcaaacactgcaaatgagggctctttgtactgtagagctacttgttaaatatttaccagcttactactgccttttcttaactgtgtgaccttcgacaagtaacttaacattcttgtgcctccgtattctcgtctgtgatacagggacaacaatagcgcctacctcacagagttacaaggaataaataagatgatatatgtggaaagcgtttagcagaattcctggcacagagccagccaatcagtgaatagtcactgtcaatattattaagacaatctacaagtagcctttcctcccacccaagctgggagcacccatcagagatgacctaacttgaagttcatcaccctgtactgggattgtcagtttctgtgtaactttccctctttagaaagtgagctaattgacagggctaattgaatttcctcttccaagaacgtaaccaatactgatacccagtaggtcctcaacaaatttttggattaaatttagttaaaacagtttagaggctactgaaaaatcagaattaggaaacatggaagcttccccaatcacataaatatttaagtactaataattctccacacaaaagcattgctggaacattgtgtttgaggttcatttcttaggagtaccccatagtaaagtcattccagaactgaaagcgccctgaattggtgcctggacagacccactgcacaatgaactctgttttatatcagagttctcagtgtatataatatggagtcctctgattgtcttagcatgtcaagtaggaatatgatcggtaactttccaaaacacttgaaggtggctggaactgctttttgcctcaagtatttagagaaaaaagaccttgatgtcacatcaacaaactcaaaaagagattgtgcatacctggagtgctttttctaggcctgggaggcagtgattgggggctgatttcaggaggaaagaaggggagaggctgaaggcatgttgaaaaatcatttttttgtctattgctcctttgtatgaactggttgctggcttatgcaatgcccagtaattaaaatggctggaatgctttgcatttttaaggcaaagtgaaggcggctcagaggcctggagccggagccagctggaggggggcccagcaatcctaccctggccgccccttggcctggcagaggtgactggcatctggcttgttgggggtgggggggcagcatgtggcaaggaggaggaaggaagtcagaggtgtcccgagttgttcccactcctctcccctttccccaggcaggtgggtgcaccaagatgcatgcctctagaatgaaggtaggcacaggccgcccaccttctagaagtccgtaatgactagtggcaatgccaagtcatgataaacaataataaagctgttctttattaaatatctatcatgtttcaggtcctgtattaataacattgattccaggactttcacaggtgctcaaatccttgatataaaatggtatagtatttgcacataatctaaacatatcctcccacatactttaaatcatctctagattacttataatatctaatacaatgtaaatactaagtagttgttatactgtatttttaaatccatattattattatttttttttttgagatggagtcttgcgctgttacctgggctggagtgcagtggcacgatctctgctcactgcaacctccgccttctgagttcaagcgattctcctgcctcagcctcctgagtagctaggattacaggggtacaccaccatgcccagctaattttttgtatttttagtagagatggggtttcatcatgttggccagtctggtctcgaactcctgacctcgtgattcgtccatcttggcctctaaaagtgctgggattataggcgtgaaccaccacgcccagccaaattcatgttttttttaatatagtcgtattgttattttttattgtttgttttttccaaatgttttccatccacggttggttgaatcccgatgtggaatccacagatacagagggctgactggattatccgatttcaagagaaaaaaaacgagatcatattactcttctgctcaaaactctatggtggatccctaatgcacttgaagtctaaatgccttggccttctagacccagcgtggcattgcccctgctgtggctgtccatgtctctcccactctcacttgtgtttacactacactgacctccttttcctcctttaaccaagccaaactcagtcccagctccaggactgccctgaccctccctctgcctctcccaggtcttgccatggccagtcagatccttctaattctgcagcttccagctcagatattaccttctcggggaggtgtgccgcagcggaggagcacagccatccccagtcactggagcctcccagggtctcatttttcacatggatttttcttttctgggcttatcagtatctgaaaaaaacttattaaaatgtttattaattgtcctttaattctaaacaattagtgtttctagctgcacaaagaaaacagtgcaagatgcctgtcttattcactgctctgtccccggtatcccagatcaaggctcagtaaatatttttttgaaatagtgaatcttcacaacaacccagtgaggtagacatcatcatcctcattttccagatgagaagacttaagctcagggaggttaaatcacttgctcaagggcaccaataggaagcgatgtcactgaggtctgtctgatctgaaagcatatattttaggatggatatatataaccttcccccacagacagctactctagaaaacagtagaaagggttgggtgcggtggctcacgcctgtaatcccagcactttgggaggttgaagcaagaggatcacttgaggtcaggaatttgagaccagcctggccaacatggtgaaatcctatctctactaaaaatacaaaaattagccgggtgtggtggcacgcacctgtaatctcagctacttgggaggctgatacaggacaatcacttgagcccaggagatggaggctgcagtgagccgagattgcatcactgcactctagcctgggtaacagagtgaggaaaaaaaaaaaaaaaagaaaagaaaagaaaggaaaaaaaagaagttggcacattcgggatgctgaagtatgggtagacttggttaaagacagagtatcatcactggtcctatccgtgttgaacactgcctccctgatgaaacctggtccttccagcccccagagtctgccccagcctcccattccccctctttattgtagccaagcaggacctgtgcccttcatcccatgacatgagtctcatcttcttcccaccatgagcttttgaaaatgttttattttgacataattcacttaacagaaaagctgcaggaatagttcagagaattaccagataccttttacccagattccccaaatgttaacatattattaaatcccccctcctttaggttgtttaagaataagttgcagggccgggcgtggtggctcacgcctgtaatcccagcactttgggaggctgaggtgggtggatcacaaggtcaggagatcgagaccatcctggctaacatggtgaaaccccatctctatgaaaaatacaaaaaatttgccgggcgtggtggcgggcacctgtagtcccagctacttgggaggctggggcaggagaatggtgtgaacccgggaggtggagcttgcagtgagcactccagcctgggtgacagagtgagactctgtctcaaaaaaaaaaaaagaataagttgcagacatgatgctcctggtcccctgaatatttcaatatgtacttcctagaaataaagacaccatcaacttttgtagtgtggagcagttcagccctggaggcacacaggcctgcattccaaaccctaactgtacctcactgtgtgctcttatgcaaaagattttgcttctctggaactcagcttcctcggctacaaacaagggcactaacagcacccacctcatacggcaaatatgaaaattaaatgagatatcccaattaaatgggagccctaagggccaagcactgcttgggatgtggaaagtgtgcagtaagtaaatgggattgtatcttgctagaatgctgtattttttttttcttcttcttcttcttcttcttctttgaagtggtttgaattccttggatttctccttcttctcaggccaagtctcataggcaaaagcaagacaggttctgtcattcattcaggctttatttactgagcccctacaccaggcctgaccctgttctgggtacagagacagagcaggaagcaagacagacacagtcctgttctgagagctgagagagcttgcgttggcctggtggacacagaaacagatggataaaccatctcagcgggccatgagtgcaatgaagatgataagacagagtaacttgtgggatgtggagcatatagggtctccttcagttaaggtaatcagagaaggggaaagtttgactactttcttttaatctgagaaaacactctctgggaaaatgtcaggcacaataaatgttttcccaacacttgaatgcacagtgggatgcacgagcatttgaaatccttgcagaagaacacactaatgggagcaagccaagtgcttctctcccacttgctgggagccagcatgtgttattccatcagccccccaggactccatcttacagagaaggagactgaggttcagagaaggggatccctttggccaagaacaaaaagaaagtacgagggaccctctgacaacatgtaacacccaagactctacccggaagcatggtgtcaacttcctagtactcacaaggaaaaaaatggcaagttgtaattgaaggaaagagccctgggccaagtgtcaaagacgttctaactctggctctatcacttaggagccatggagtctctgtataaccctccacaacaagagctgcaccgactgaccccagagctgcaccgactgacccctctcatcccctccagctgtaacagactatatgcattcacctggtttttttttgtcctttttttttttcttcctctgcctcctcttcaataaagaaaagtaacaaaagagggaagagaattaggaaggaaaacagatcagctgccaccatcacttgtaccaagtgatcatacctggaggcaggaaggggagagaaggctcctctgtctcagaagatccagcccagtgctttgtgcacagttggggctcaagccctgccctggtataaacaggagcatttgcatgcatttgttctctcgtgcccattagaaaatcagcaacattattttatggccacagctcatgcagtgtgcaaataatgcctgctgcgatatgctgttctcttccagaacttctgttttaaataggacactgacataagtagagaacttccaaagtaaggtaggtgagggagagttaccattgttgttagttacctatgtattgctgcatgacaatgttgccatacactctgcagcttaccataacacatatttattatctcatgatttctgtgagacaagagtctggacatggcttagctggctcctctgcaaggctgaaactaagatgtcagccagggctgcagtttcatctggaacttgactgaggaagcacctacttcctcactcacttgattgatggcaacatttggttcctcagtttctacctggctgtgagctggaattcaccctcattttcttgccatgtgattatctccacaggcagctcaccatgcggcaacctgcttcttcaaagccagcaggaaaaagtgcctcctcccaagatgggcattccagcctcatgtaacatgattgttcatattcatataatcgcatatgccctgtcacctgcgccatgttctattggttaaaggcatatcacaagccccaccatcactcaaggtggaggaattaggcaaggctgtgaataccaagagtcagggatcaagggagccacgttggctcaccctccaaacagagtagagagaatgacaaaagccccagaaaacacagggtctggagatagttggaagcacttgcaaagtttaacctgagaaagaggaaaaaataacaaacacttatattgcctttccaaggacttttgaatatattagctcacttaaacctcatccaactttgtaaggtaaataccattatcatcccctttttacaggtaaggaaactgaggcacagatagttcaagtcacatgcctaccacgacacagttatagtattgctgggagtcgaatccaggcagtttggctgcagaattcatgccaaagatgagattggtttgtgccaaagatgagattggtttgtttagtttcccccaaaagacactaggaccaaagggtaaaagctgccaggtggtagattaggggtttataatgataaagagcaagtaaaactgtgagttctggtgaatttcaaactcctagcaggagagagcaggggtatttcagttggaggctgaacaactgtatttcagagacggcgcacaggggattccagcatggtaaagaacagtggacaagacatcctctaagcccccttaaatccgaagattaaaaaccatgtaaaaactagcaatctcaaggctggatttggcccacagatgccttgtgtttggttcatgccgcattttaaaatgtaattcacaaactttcagaaaaattcagattttcagtaattccagtttccagcttctcctgaaaaaccagaagctccgggcccacattgcaaggaattacttagcaggggcttagaagatgctgtccaggttagatgaagcaagtgtactccaacccgtcccagtggacagccttctgtattgtctctccaactgaggccacaggtctgttatttgtcatactcacctgtttcaaggccctgaactgtaccatgaacttccaagtcaggcatccaggcaatataaacctgcatcaagagaggaagcacaggagaaacccggtcttagtgactgtccgagaagctaagtaaagataagaagggggtcattgagcttagttctctgctgtggactaagattaagtacctggcttccccagatcttcaattcccataccgtttaatgggaataacaggttctggtctcactactctctgggaagcttcaatgagaagtgcttaactaactcctctcaatagagagttgcttctcaatagagaattgctccttctcaatagagaattgcttcactaattcctgttcatccttcagggcgcagatccataggctgagggaagccaaatcctctgctacaattacaaggcctgggctgggcacggtggctcacgcctgtaatcccagcactttaggaggctgacgcgggcggatcatgaggtcaggagatggaggccatcctggctaacatggtgcaaccccatctctactaaaaatacaaaaaattagccggctgtggtggtgtgcgcctgtggtcccagctactcgggaaactgaggtggaagaatcacttgaacctaggaggtggaggttgcagtgagctgagatcatgccattgcactccagcccaggagacagtacgagactctgtctcaaaaaaaaaaaaaaaaaaaagaattacaaggcctggccaggcgtggtagatcttacctgtaatcccaacaccttgggaggccaaggtgggtggattacctgagatcaggagtttgagaccagcctggtcatcatggtgaagccccatgtctactaaaaatacaaaattagctgggcgtggtggcacacgcctgtaatcccaggactttgggaggccaaggtgggtggatcacctgaggtcatgagtttgagaccagcctgaccaacatggtaaaaccccgtctctattaaaaatacaaaattagccgagcgtggtggcacccgcctgtaatcccagctacttgggaggctgaggcaagagaatcgcttgaaaccaggaggcagagtttgcagtgagccgagatcatgccattgcactccagcctgggcgacaaggtgaaactttgtcaaaaaaaaaaaaaaattacagagcctgaaacttattttgtttccttcttactatggaattttccttcagaaaaaaagttctgaaggggaaaaaacaaccttctgagaagatagaaagaggagaacacatggaaggaaaacttcattgcgaaataagaaatctttgacattgcttgtctgttctgtttaaaaaagaaaactgttttgtaagagaatgaaaaaggaggaggagaagcatagtctgctgtaaatctactcagtaatccaattctctgtgcccaagaatcctaaggcagtcctggaggagaaaagtatcagaaaatgaactgggagactctcaaatagcaattgtgtctcagccctagctcagccaatcaacaacaacaacaataataataataatattaataataataataatattagcaaacacctaagtaacacctccttaggtgtttgctaatataataataatagcaaacacctaagtaacacctactatgtgccaagcactgatataaacattttattattaattcctttaagcctgagcccagccctgtggggtaagtgcattatcgtaatgccaatttataggtggggaaaactgaaacccagagaggttaggtaactcgtccaaggccatgtagcctattggtgatagagtcaggatttaaacccacatagccttgctccctaagctttgtgtccttaaccaccatcatctattcaggctctcagggatttattgaggatgtacttgttctataaggtactatgctaggcaccatgagggtgagagggaggatgatggaggagtcagataagagtgaattcctaaaagatggcacttcccagtgagtccattttctgtctgtggaaccttggacaagactacgagctattgagccttgcaggtcttggtagttccagggctttatacaatttaaaaggatttgtttattgaaaggagggatgcagagaaggaagaagggaggaagggaggatggaagggagggagggaggaagggagggagggagggaggggaaagaaagaaaaaagagagagagaaagaaagaaagaagggggtgagagagaggaaggaaggagggaaggaaggaaggaaggaaggaaggaaggaaggaaggaaggaaaggaaggaaggaaggaaggaagcaaggaaggcaggcaggcaggcaggcaataataccaagttgctctcattaagtgcttattacgctgggtactgctaagtgccttacctacatgaaatcatttaatccttataataacaagcctacattgtggttaatattattattacctccattttaaggataaagaaactaaggcacaggaagttcagtagattgtccaaggtcatgcagctggtaagtcagggagccaggattccaaccatgcagtgttatttcagtgcccaggctctgagccagtgacgaaaacagcaaatatttgaggtcaaggtgtaatccctcccatatgcaaggcacctggtgaattacaaagctctttgtggaaaggcttccaagggtggagatgggggcagaaatttccagggtcctcagccagagattctctgataacacaggtagaaaataccaagggctgcagagatgcgaaaaggaaaccagagcggccaacagcgcactgcacagaggccctctggttttagagtcaactcaggtgctgctctgtctccatctcctacagcagttgtccgatcacctgtaattttagcccccagaacaacactcctgagacacttctctcattcacctcccggcaccccccagggccagcttcagcccgtgaaattccagcacagttcagcaaagcacagaccagacatggcgtcccacaccagtgagctggcagctgcttcctttgtaaccagacaggtacacaaagaaaagcagagatcagggcagaaggcttcgggctcagtcagggcaggccatttctgttttttttctctttttttctctctctttttttttttgagacagaatctcactctgtcacccaggctggagtgcagtggcgcaatctcagctcactgcaatctttagggcaggccatttctctgtgggccttggcaaggcctggaggcagatgcagaggtttgcaccgcctcaccataaaagggagcgctttgttcctgctcccctgctgtgtttggcttttctgcccaggttatcccagggcagaatggaggttcgagtacttgcccaacctggacccttgatggtactaaagcgtggaggagtcgctagcaaggacatcacggtagtaacctgcaaagtacgtaaggtcctgtttttcctattcatgcatcccctggggagactgggcatttgggagaaaagcacagcttgggtttgattcccagctctgcaactagccagctgagtgcccctgggtaagtcattacactgctcagagccaaggtttcctctcttgtaaagtgggaataataatgcccgcttcggagagttgcagcgaagattaaatgagacaatctggtttgtggaagaaacttaatgaggggtgactagtgatgtctcttgtatggttgcttcatagatttgtttgtttgtttttgtttttcgagacagaatctcacgctgttgcccaggctggagtgcagtggcgccatctcggctcactgcaacctccgcctcccaggttcaagtgattgtcctgcctcagcctcctgagtagctgggactgcaggcgtgtaccatcatgcccggctaatttgtgtatttttagtagagatgggtttttgccatgttgtccaggctggtctcaaactcctgacctcaagtgatccacccacctcggcctcccaaagtgctgagattacaggcgtgagccaccatgcccggctggttgcttcatattttaaatccatcattcaccattcctatcaatcctctgtggccacacatcacattttacattcatttggatttacattacattttacattcatttggatgattatttgattaatgtcagccttcctcactagtagtatgaaggtagggactatgtctgtcttgagccatcgttctaaccccagtgcctaaggcaagctgggcacgtaagaggtgctcaataaatatttatggaataaattaataaaggaaatgagaagtacccaatacaatggtatattcatttatttggagcaaagtgttacaaatcagtttttattattgatagtaaaagtcctggagtttgtgtgttgctttcttattaagaaacaaattaaggtatgttgaaggttgtcttcaaaataatgtcatcctcttttgcttgcattttgacgcactttcttcggtgacgctgcagttaaatgcaagtcctagggattccgcttcactcagcgtaaaccctgatactggctcccatgggaatatcatccgtcattgtgttgtgatggaaacaggagattaaaaaaatgcagtcttggccgggtgcggtggctcacatctgtaatcccagcactttgggaggccaaggtgtgtggatcacaaggtcaggagttcgagaccagcctggctaacatggtgaaactccatctctactaaaaaaaaaatacaaaaattagctggacatggtggcgtgtgcctgtgatcccagctacttgggaggcttaggcaggagaattgcttgaactcggaagtcggaggttgtggtgagccaagatcgtgcctctgcactccagcctggtgacagggtgagattctgtctcaaaaaaaaaaatgcagtcttacatcacagaacaccttttcctgtagctaggaaatgaggcatgagaatagccttgtctcccacttagagggcatgaaaactgagaagttaatgtttctgagatccttgagtgaaaggcacagacttatctgcttcctgccatagaatgtcctgccttgagatgttgtttatcaaaccattaatcctaatgtgtcttcaccagccagcacttgataggataaaagcattgtcctcttggagtggcagctggcagactctattctaacacgtaggggcctccttagcaataatgtagtgtttctcactggaagcctcacatacctctgagacgcaggatggttttaggtggcatcccaggaattctttctttaatagttaaactttttagtacaacatgtagtcagaaaaaactagccaattaaatccatgaattcatggatattattgcttagggtgaacccaaagctagcatttaagtaagacaaaaaaaagagttaattcaaagaaaatactaagtaaatatgaagagtaaactataacaagaaaatgacaaaaatcataagcaagaaaagctaatatgtgagtttcagaaatgctgctattatttattttcttgcctctctccctgtaaatctgagggttctttggggatattctttatatcccagtgtctagcacggtacccgacacacaggagctcaggaagctcagtgaatgagggatggatggatgcaaaaatgatgaactgatgatagaatgtttagatagacttggcatctggggctctgacagatccactgaagtaaagtccctaccaacatactggggacaatattgcaccgagtcaggacttttcttcctaaacaggtttctgtgtgataataattggattaaaaaaaaagaaggagcaggctggctccaggccatgaaatgaaatctaatgtgcccatatgccagtttcccctttttaggattctcccaaccagaaagaatttctagctgcctgagatgaatggggagctgggaataccgagacccacagctgggacacgaaggatgctttcgatagaatatactagctgtgtggtcttcgatgggtcactaaatgttcctgcctgtctccttctctgtggaatgaaggagtcattacagctaaagaaattatgtgattctgggaggaactggttctgaatttgaaagccacggagaagggcaggtcgggaggaggtgctgatgagctggtacaaggctggattcaggcttgaagaactcacgtgacatctagtgatcatgctgtgaggtcagcattgtggttctgggtggtaacatctgtgagttcacccacgggcacttcgaggcttagaaactttcctgtgtgtgctcaagggatagggggcggctcctgctgctggtgtccccacctatctcagtgatgaccagggtagccttgccatggccagctaggtaagcaggtttgcttccactttgaattcttatgccttctccgtgcactgcactttacagtttacaaaatgcttttcatgccctctgtcccatctgatcctcataggatcccagaataagccacttagggtagtgcagagggagcatggtaagccattgctcaaggctgcgtgactggctcaggaaacagagcatccattctggtgcaaagagctcgcctcaaggtggcctaaggcagcaacttggagccagacccttcattcaaagcctggcacaggtgcccgctgtgtgaccttaggcaagctacatcacttctctgggtggcaattcttaatctgtaaaatgggatgttgacagtatctgcctcctagtgctgttgtgaatattgaatgaacactacctggcacctggtaaggcatgactatcttattgcctcatgggtgactctgaggatttatcgagataatgggtgtgtgtttctttccttgggctgccataacaaagtaccattcaccaagtgacttaaaatgacagaaatttattccctcacatttctggaggccagaagtcccaaactggtctcaatgggctgaaaaaaaaagggtgtcgccagggttgtgctccctctagaggctctaggggagatcctttcctgtttctgatgactgtccaagttccttggcttgtggacacaaagctctgacctctgctgccatctgcctggcctcgtcctctgtgagggcaccagatctctctctctgcgggcaccagatctctctctgcctgcctcgtataaggatacacgtgatcgtatttagggcccacctgggtgatctaggataatctcctgatctctaggtccttcatttaatcacataagcaaacctctaccccctacagccccctgccacttcctttttcttggccacaggaggtaacattcacaggtttcaggaattaggcatgaatatcttttggaaggccatttttcagctgacaacagatactaagcccttagtaggtacttagaaacagtagctatgattgttaatcatcctgttttacataaagggaaactgaggctctgagaggtggagagggattatctcaaagggccaggaagtggcagaatgtagccttggcagcagaactcctgatctcaaggacttatggctatactaccatgataccttgaggttggtgggttgtttgagtgttgccaagtttgtatgactggggccacccttctgggttgtgcagactggaggatgcattaggctaaggatacatgtgtcctctactgcaatgcaaaggagaaggggtacttttgcctcagtcaccctcctcgtcgacagttatctgctatgggaagtgggaacagggaggaccaggtcaccactctcttggcattccacaggtgtttgtggctcagatgctgctaaggactgaattatgtccccccaaaattcatgttgaagcctcaacctccagtgcagctgtatttagtgatagggcctgtaaggaggtagttagattagacaaggtcagaagggtgggaccctgatctcataggattagtgtccttataagaagaaactctagagaacttgctccctagtccacctctccacactcctgcatgcacaccaaggaaaggctacatgaggacacagtgagaaggtggctgtctacaagccagcaagagagccctcaccagccagagccttgatcttggacatccagcctccagaactatgagaaaataaaatctgctgctaagtttatggctgtccaagcaggctgagacagataggtcagaggaggaagctgggggccttcttcaggattggcatttgtcttatctgcctcagctccacggaggccctcagcatttgttgaatgagtggaatgggtaaccagacaagacccctgttcagtttctaaacactctgctcatttaaaagtgcaaagctgggaggccgaggcgggtggatcacctgaggtcaggagaagaccagcctgaccaacatggagaaaccccatctctactaaaagtacaaaattagccaggtgtggtggcacatgcctgtaatcccagctactcgggaggctgaggcgggagaatcacttgaaccccggaggcggagcttgcggtgagctgagatcgtgcgccattgcactccagcctgggcaagaaaactccatatcgggaaaagaaaaaaaaaaagtgcaatgcttaaaacagaggagagggtgagccttatttgaggctcctgaaaactcttgcctgtggtgttccaacagcaccctacccagtcttcttgcctccagagtgtggacagggcttcatctctgtgaagactcgaggggaggagggtccttccttatctcttccagtttctggtggttgctagcaatcctgggcattcccagttttaacctctacctccatcatcacacggcattctctgtgtgtctgtgtccaaatttcctcttcttatgaggacaccagtcattggattaaagcccgccctaatccactgacttcattctaacttgattacatttgcaaagaccctatttccaaataaggtcacatttacagggaccaagggtgagggattgagcatatctttttggaggttacatttttcaattcataacaaaccctcatggtttttcttgtccccaggatcaatccaagatccgttcatggctatcccatcaagaccctcccttcctctccctccaagcccatctcactcttttctttcctgtccttgggaccagcacacactggaacttcttgctcctcagacacattctgcttccccggatctcccttcctttgcttctaccagccctcctactggcagttccgttccaaaccttgtccacttctgactccagctcatcttgcaagactcactttggatatcagttctccctgcagcccttcctcactctccctccttcctcttcagatagaagcaacctttcctcccccatagtaccctctacctaattcagttgcaggccctgtaatacttcactgcatcagtgtgtctgtctccctcacttgaccatgatcctcttatgaacagacactgtcctcaaggcccagcccagagcccagcatacaatagaccagtgggtgcaaattggaggctcaagggctagatatggctgaacagatgtgtttttcttcagtctgcatgacatcaaccagaattgaagatagctaccaacaattacatccagaaaatttctcataaaaatctgtaattcccacctcttttgagaaagaggaggatctggccgtctcagatctttgtccccagccagcaagaacctactgaagctgaatcactactgtcactgttgcgttcttttttttttttttttttttttttttttgagacagagtctggctccgttgcccagactggagtgcagtggcacaatctcggctcactgcaacctccgcctccagggttcaagcaattctcctgcctcagcctcccaagtagttgggactacaggctcatgccaccatggccggctaattgttgtattttagtagagacagggttttcactgtgttgcccaggctggtcttgaactcctaagctcaggcaatctgcccacctcagcctcccaaagtgctaggattacccatgagccaccacgcccgacactgttccattctttggacagggcctttgctccccagttgtattgggacacaaccatgcctattcatttgttccttgtctatggctgcttctacatggcaacatcagagttgagtagttgcgagggagatcatacagccccagatatttactatctagcttgcactagtttcttgtggctgctgtaacaaactactacagaattggaaaccccaaaccagctagattttttgtctcgcagttatggaggccagatgtccgaagtcagttctactgggctgacatcaagatgttggcagggcatcctcccttcagtggcctgaggagagagtccctctcttgcctcttccagtttctcctggctgcaagtattcccggacttgcagccacatcattccaacctctggcctcatggtctcctacactaatcattttttgtcttaagtctccctctgcctcttctgcccaaatgtgagcatttggggctcacccagatgattctggataatctcctcatctcaaaattcttaacataatcacatctgtaaaggctctttttccaaataagttaacatttatgggctttaggggtgaggatatcattggtggagggaggcggatcatttttcagcctatctcatgtccctatacaaaaaagctttgctgacccttgttctggaaggacaaggaagcttgcccgagatgggacagctcctacctctgattctgcccttctggaagccccaggctcactccacatctgtatctggggtcacaccagggttctccattttgttagatactccctagggctgccttgatctccctcatacctgcctccctcctcttgaaaaaaaaaaaaaagaaaagaaaaagaaagaagaagaacaaaacaacaccaacatctgcagcatttcttgaccttctggtcctgcttttctccccccctgtggcccagcactatcctcagggacagaaagaatgagggaagtttctagcagaaaaggtctattttccaatgtaggatcctttcttccaggcttaatggctttttcagatgtcctaggagggttttgccccatcctctctgggctaaaactgctctccagacagcctagtgcagcctcatgcacacaaccacccttcccacattaaacggctgtgctccccaaccctcaaacaaacctgcttccaagcagcagctgcctaagaaatgtactccctctcccctttctaattttgaccgttggaagagagatctagattcgtttctgagtgtcttccttggccagtaaaactgtagcacaaatgtcatgaatgaccatttgctttgggaatgaatgaataccacagagactcacgggtaatctccatgtgcagtgtgcattgtttaatatagtccccaagcttgaaaatgaataatgggcattgttcatcttttgtagggtatttgaaatggccagtcatgtacaccgaatatgatgtagatgtatttgggcatcagtgtgtcctgtgaccctcccctgtgagggaggcaggcagatattatctccattttaaagaaggaaaattgaggctcagaaagatcaagtaactggcctaatgtcagacagctagtagatgcagacctggtcctggtgcccattcttcaccaagtgttgtttccaccagcctgggcaggggccactgtgctgtgttacagatgcagtgcacaggggcccaaagagcctggcagggaggttaggggtggcttctggtcaccaactctgtggttgaacctttttcctccggtactcaactttcagaattttaacatctccatggtggacaacttcagagggcaaggctggttatataccatggaatactatgcagccataaaaaagaatgagttcatgtcctttgcagggacatggatgaagctggaaaccatccttctcagcaaactaacacaggaacagaaaaccaaacactacatgttgtcacccacaagtgggagttgaacaatgagaacacatggacacagggaggggaacatcacacaccagggcctgttggggggtgaggggcaaggggagggagagcattaggaaaaacacctaatgcatgtggggcttaaaacctagatgatgggttgatgggtgcagcaaaccaccatggcacatgtatacctctgtaacgaacctgcacgttctgcacaggtatcccagaacttaaagtaaaataaataaataataataataactgaacacatatgtgttaattgaacacatatgtgccaggcactcttccgtgtgctacatatcgagtaatccatttaatcctcccagcatccttatagaatgggtgctcttgctatagttaccttacagaggagaaaacagagacacagaactgttaagagccttgactcagggccttacacctattaattggggaatatggaatgtcaggaaccatgtagttgctgtattatatgatgggtaaggagggtctctccaacgaagcagagacatgaacaaggacagagacagagagagccatgtgggtttctgggagaagaggttttagaacaagggaacatcaagtgcaaaggccccgaggtggtagcaaactcggggtgttctaggagcagcacgaggagcagagagagtgacgaggagaggcagaagatgagggtagagatgttatggggatagggaagagcagatcacacaggccctgtggctcatggtaaggagtttattttattcagtgggagatgggaagtcattgcagagcattgagcagaagagtggcatttgacttacatctgaaggcatcaccactctgctatgagaagagattggttgtggggcaagaacagaaatagagagagcatatggaggtgaatttgccttggatcaggagttagtgatagatgtggtaaaacgaggtcaattctgattttattttgaaggagaatttgctgatggattggatgtggagtgcaagagaaaaagttaagggtgactccaaggtttcggggctgagcaaatgaaaggagctgccatcaactgagatggggaaagctgcagattgaacagtcaggggggctagaagtcagggtttgcctgctgacatattagactagaaatgcctattaggcctccaatgggacatgttaaagaagcagttgaatctatgtaaatttgggagttgtcaacacatggatgatatttagtcatgagactgaatgagatcaataggggagggagtgtggagagagaagagcagagccaggagtgctacagtgtttagaagtcagggagaggccaggcgcagttgctcatgcctgtaatcccagcactttgggaggccgagacaggcggatcatctgaggtcgggagttcgagaccagcctgaccaacatggagaaaccccatctctactaaaaatacaaatttatctggacatggtggcgcatgcctgtaatcccagctactcaggaaggctgaggcaggagaataacttgaacccgggaggcggaggttgcgttgagccgagatcgcgccactgtactccagcctgggcaacaagagcaaaactcagtctccaaaaaaaaaaaaaacaaacacagaagtcagggagataaggagccaccggcaaagttgactgagttcaactcagctgatgagaatcaagagtgagagagtggtgtcccagaagccaagtgaggaaagtgtttcaaagaggtggaatgatcaactatgtcaagtgcagcttcatagcgaagtaaaacaagagctgaaattctgccattatatttggcaacatggaggtcattgatgaccatagcaggtggagggatgggagtgaggtcgagagagaatgaaagagagagcagaatccagaggtatagactttttgctgtaaagtagaacaggggggaaatgggtggtaattgatggtgaatatagggtcaagaaagggtttttatttttaaggaagatattacaatggcgtgttgaaatgaatggaaatgatccattagaaaaagaaaagtggatgccggagaaagaggagatgtgggtggagcattgtcctagaatcggcgaaaggggtgatacctagagcacaagtgaagggtttccatggagtaggagcacagggttcatgcaaaggagcaagagggaaagcagggtatatggaataggtactggaaggtgggtagatgtggtgctgagagctttggcagttctcttcttattgcttctaatgttttcaatgaaatttgaaacaaaatcatcgtcactgagaatctagaggagaaggacatatgagaagtgtgagatgaaaggaagcaatgttaaatagttgcctggaagagtaggagaatgaatgggctcaggaagtactatgggatgagtcctgcagttcatggtcacagttttctccagccatgttcagatgtggtatatttttgcaaccaagagaaaaaataagataaaacagagtgtttatagtacatagaaaggcaagatttgttttgaacatatatttgaaatgcccatgggatacacacattagatatccaggaagcagttgattatacatatatggcttggagctcagaaggaggtctgggataaaggtagaatcatcagcaaagaggtggcgattgaacctgagaatgtaggtgaggtctcccaggaaagaaatataaagagaagagagttgggcataaacttgggaaacatcctaattttaggggtaaaaagaggaaagccatccatcaaagaaggcagagaaaggggcgaatatgtagatgaagcatgtctttccagcagcctagaaatgagacagttgaaagaaaaggagtataaagttattcagggagaccaaggagaaggagaaagaccactgaattttcccagaaggaagccagagctgggttatctcagggcacttagcagaaatgcaaagaaaaggaaatcatgagcaaaaagatagggggcatgaaggaacagacccaacagagctatgtgcaaataattggaactttggaaggagagagaggagtaactggaagagaaatgatacttttaaagatataatagaagaaaatgtctctgaactaaagaaatacctaatttgtctgatcaaaggggtgacatgttaaactagaaatgcgtgttagacatccaggggaagatgttgaagaagcaattgagtctaggtaaatttgggagtagttaacacatagattatatttaaagtcatgaggctgagtgagatcaacaagagaaggaagtgttggtagagaagagtccccaagtcctagaaagatgaatgataaaatcaatacaaagacaaaatctggtgacaattctgagctctaaagagaaaatcctaaatgttctcagagaaagaaagattacagtctacttacaaagaaaataaaagaaaagaaagctgataccggattactcatctgcaacaatgtaagttcaaagacagtggaataatgttcttacactaatgaaagacatgaatatgaactagaattcccttacctagtcatgacgccattcatattagaggggctctaacaccctaggataccatccataggccctttctgaggaaattacttaaggatgtattccaatcaaatgaaaattcagtcaaaacatggatctcaaaatgagggaagataaatcatgcaaataagagtgtgtgtgtgcatgtatgtgtgtgtgtgaagtcaccagcaatcatttgaaggagcaatcctaggaaagtagtgggagcagaaactggattgcaggggacatgaaagcagtaaccagataatattcctttaagaaacgtggagacaaaaataagaagagaaggctacttgagggtcagaagaacacttgactttatttacgaaagcaaaaccccaagtgtgcttgtgggcagaggaaaaggagttgtgagtaggcaggtgtgcaaagtacacaaataacatgtgtagcatccctgatgcgcagtagggattgagtcaattccgatgattggagaataggattcattctatcccggaaggcacaggcctataactgatttggatttggaagggagggagagatgtaagaactgtcaggggaaagaaggaagttgagaccatggggtcgcaaatggtctactgtggatacccaactgtctatcagaattgcacacgtaagtcctgtattttagtatcagcgtatttaattctataatctggagtgttgcccagtcagtgcagcattcagctggaatctgtctatacccattcccactcaaccaaagtaaacctctggaaaggtttattctgaagggtacaagggactgatactttatttatttagaggaaggatgaattggagcatatctgggaatcctagactgggtacctgggggaaaacatcaagatatttggttctcagtgacatgatgaaagtagaagggctcacggaggtggggacaggagcctaggacaaaatcaggtgatgatgtgaaacagcagtgcataagaataggattggctgtgcgatgcaataggtatggccttctgggtgcggagattcaaatcttggctttcattcactgtgggtcattgagaaaatgattccacttctctgagcatcaggtccctcatctataaaagatggcaacagcagtgaccttgcagaactgctgtatcacgctgattgaacaggttgttgtggagggcctactatgtgccaggcattgtttccagtgctgggaatttcttggtaaagaaaattgtacatgtttcttcctcctggagcttctattctaggtgatcatgagaagtagaagaagaaagcctgcagatacacagctggggtcatggaaagcacaaaaggtgctcagcacatacccacttccacctgatcccttccctaagtgccttttccaaaggctctatatctcacccacgccccagtctttctccccatgtcgggcagaattgtatggctccaaatacctcctccagttctccaaaccacagaggtgcaagctacctggtttttcagcagaaacaaaaaccaaacaaatgaacaacaacaacaaaaaccttgaaaaccagcctctctcatctggacaaagagctggaagaggaagcctagtgcttggagggcccctgggtttacaggactggaatctcagacccagcttataagggattactctctataagttctccatctcagattggctcctggcccttctctaaggttcttccacacagcctgagtttgacacataagctccaaccattcaaaaacacaagatcctgcattcagtggtgtgtgatctttttttgaacacccaatctttgtctctgtgcaaaggggtgcacagtcccccagccttcctcctccccttctctatctctagcctttcccaggcctcccgctcctgccagccatgcccaaactcttaacgctcacgtgtccagctctcccaggagtagtttccgtttgtggcgaaccctccttgctatgcgaccctcctccactgtcaccctctcgcctgtcattttctcattatcgtcaccaccccagccccaaagttgtcctccactttcctgtttttcaattaaaccttgtcctatcaggaatcctcagccaccttgttctgtggttaccagagaggaaaatgacagcatacagggggaaattcccactgatcggcctcaaggacttggccagagatatcccgggaggagtgagaagctgcagagaccccagggcagatgaagtgggcgagcgaggtttgtggcgggtgtgggatggggtgtattttctttcctcgccttgtactttcttttcacagctgctgctccttgaagaccccgacattccagttcccagagctaattttaacttcttgggactggcttgttctgagtgaccctcaccactgcctctctggccctctggtgcacacagtccacactcacacactctctcgctctcaaaccagggaaaaatagttgtcatccaggccagcaaacggcgaggtctcaaagaccctcaggaagccggaaactggacagtggggtggggtgggggcgcaggatggggccctggaaggacaagagggtgggggtggggaacaacttcctgcctcccaaataaggagatgatgtcaatcggctcagtcatgatttcacaacctacttaagagctttgaggagagagactatgagggaggaagaatgtccatgaatcagaatgaggacagatggcagaggcttgccattgctccccaccactgcaatgttcacacatgtgaacttcaacctgctgaaggggctgagttcagattcacgccttggggtctccagtcaggagatagaatttgcagtaagttttaaatgcccctaattccatagtggggaggcaccaagagtcagagacatcacgtgacttcccccagtttgggatattagcgggagattatgtaaatccacagccagagccaacactggaaccccagccaagaccagaacctgccttccagcccagtgttcttccaggccacgaggctgccttctgctgcgtttctgatccatttctcgtgatccgaaagcagcccactggttcctccagcacccgcagcagtgaggctgttgggtcattctcttccaaacttgctttctcaacgcagtctttgccggcttctctacaaagggtgaagttgggggttgggggtgacatccatggggaaatgagtgggccccagcctgggagtggtgagcagttacagaaaacggggacattttgtttctgtgcttgatcctctgtctgccagttccttaagaaagctgattaaaaatggggtcttcgccaggcacagtggctcacacctgtaatctcagcactttgggaggccgaggcgggtggatcacctgaggtctggagttcgagaccagcctggccaacctggagaaaccccgtctctactaaaaagtatatacaaaaattagctgggtgtggtggtggatgcctgtaatcccagctagtcgggaggctgaggcaggagaatcacttgaatccgggaggcagaggttgcagtgagccgagattgcgccattgcactccagcctgagcgacagagtgagactcagtctcaaaaaaaaaaagggggggggggcttctacaccaaattttggaggcatcagtcatcagcagcaattgtccgcttccctcaaatcctccccctactatctcagcctgcttttccataccctgatctccttcccctttcctttcagcttcatctactttcttccctgagcttgggatcctggcctttcctcacctggggaagtgaaaaaacaaaacaaaaacaaacagaaaaaaagtttcctactaaggcagaatcctccattggcttcacctgtcagactcccagtcactccagacactctccatctcgatatactggattgcccgggcagtactgcatggctaccagcatgcagactgtctggatttgagtcctggctctgcctcggttttcacatctgtaaaatggaaataaacagtgtagggttgccttgaagactaaatgagctcatatgatatgtaccaatgtaaaacttcatcaagaagtactcttaagattagagcacttggccaggcgtggtggctcacgcctgtaatcccagcactttgggaggccaaggcaggcggatcatgaggtcaggagatcaagaccatcctggctaacatggtaaaaccccatctctactaaataatgcaaaaaaaaaattagccaggcgtggtggcaggcgcttgtaatcccagctactcgagaagctgaggcaggagaatggcgtgaacccgggaggcggagcttgcagtgagctgagatagtgccactgcactccagcctgggcgacagagtgagactccatctcaaaaaaaaaacaacaacaacaaaaaatagatcactttactaatttactgtgtatatgttatgttacactttaaaaaaaagatgaaatgagttcatacattcaaagcattcaaaacagtgtctggcacatagtaagcactcaataagatactaattgttgttattgtagctattgttatttagccttggtccccttgaggactatgtgattaatattccttgctcctaagtgtctagagtaatgaaagtatctcctatttgactcatgctttctggcttaccaagctcttccctgtgcattctctcaacagccctttgagatgattactattttccttaccttacaaatggggaagctgaggctcagaaagaaggagttgacttgccccagatcatcctatcaataagtgggaaccagggcgtgcccccaagtccatgtgactttcatgcaagggcgcccgccccacctcgctctgtccatcagcagacctgttcttctatatcacctgacttcctggttgcagacactgggtttcgcgaccctggccatctttatgccctttaggaagtgacctccccaaggtctcatggcttaatacaccaaagctgaaatagatcccaggtatcctgaattaatttctaatctggcaccatttccaccacaaccttttatcttgttggtccttttccaattcagatgtgttataacaaagagaaagacattttctgtttgtttgttgttcccactgagttaaagaaactaaagccattgcattaggaattaggggaaagacgtatggacagggagcaagagggtgccagtcccagcccaccgctataaccctgaggaaggatgtatggacggggagaagagggtgccagtcccagcccactgctataaccctggggaaggacgcatggacaggagcaagaggatgccagtcccagcccactgctttaaccctgaggaaggatgtatggacagggagcaagatggcgctaaaatcctaccccactgctataaacgtgctgccttgagtcccttctcttgcacttagggttcaaactactggctcgttctgtcttcaggaagatggcaccctctggagtctgtgaaatgagaaaaccgatgccatcacccacccaagccctcgctaaggacaggtggcactcagggcagactcctgagactcctcactccagcatctgagtcattcacaagccccgcaggaccccgttttcaggtcttccccttccccatcccgtatccgacaatctccgggtgcagttattttaaggaaaattccaccaggcaaaacctcacagagacactaatgtttgagggtttggttcttcctgcctcccattggagactggttttgaggttgtttcgctgaatcactgggtgaaaagtaaataaataaatggaggaaggaaatcttgctttaaaaggaattttgtggcctccccgcaaaacaaagcagctgttatcaccaaagaaatctgcaggacctgacctctctgggactatactgcattctggggtttcagaggcacccccaccagaagcacctgccccactgccttcaagaggtgctcaaaactgggctgccagccctcaggagcaagctggctaaatcccatggcctctgggaagcctgaccttgctgttgtccccccactcccttccagggtcagtgaagggctaggagtgacctgccctggggtgttgacattctgcaaatttgctcagcttccttttgggatctcacaccccttctcgtgactcacgcgcatggcttctatcggccaccccttgcctctctctcatgtcccatttcttccctgggctcctgctcctcataaaaaccaaaggaaagagagcttttggtaatcaactagtccaatcccctcaacttggcaatatggaaactgaggccaggaaagcaacagtaaccggcactgggtcacacagcacctttgcagcaaggttaacactagaactgaagatgcattgccccctgcagcatttgaccagcagatgacccagtgggcttcaactctccacctcccagccctcagaggctggcagcagctgctgtcctctagattgaagagctggctgggacaccgtgtaccccgggagctccccctgctagagggaacagactggaaatgggaggttgagaggaacattgtaagacaggaaccccttacaatatctatgacgccagtgtttccttgaccctggaccagctgcctgggcagtgtgaagtgtcctggcccatcatagtcttctaaagcatctcactctcaaatatactcaaagtttctctttggtcctgctaaaaatctatccattgctctggttccaactcactcccagtacccctggcatttgaggcctgctgacattttcctcatcttctctccctgtctgtctttacaccgcccctctgaaccagtggggaaggacagaggagccccaccctcagagcctggtgaatttcagaagcctgggcactgtgggtgtgggctagggtagacggtgggaggctggtgtgatgtgagctctgcccacggggggccctgcatgtgccttctgtcaacctcccctgactgtggtggaagggaagaccactccaaaaggaatgtccacctcatgcccactctgagaccctgggcacatgacattacttaccatctctgagccccgtttcctcatgtgtgggatgtcactccccttcatcccacttcgagaacgagatttagcagcataacttggggaagaataaagctccaagcatgcaggaggtgctcagtaattgtttgcttctcctctccttcaaccgaagggcagggcaggagcagaatggagggagaccttcctttagactcaatcaaggaagggccgcaggcctgcatgggtgctggctgttggtgcgtggctgttggctgggggcgggtgggtgctggctggggggtacgtgggtgctggctggggggtgagtgggtgctggctgcggatgcatgggtgctggctgctggtgggtgggcgctggctgggggcacgtgggtgctggctggtggtgggtgggtactggctgctggtgggtgggtgctggctgggggtgggtgggtactggctgctggtgggtgggtgctggctgggggtgggtgggtactggctgggggtgggtgggtgctggctgctggtgggtgggtgctggctgcgggtgcgtgggtactggctgctggtgggtgggtactggctgctggttggtgggtgctggctgggggtgggtgggtactggctggtggtgggtgggtgctggctgatggtgggtgggtgctggctggtggtgcgtgggtgctggctgggggtgccgtgggtgctgactggggctgggtgggtgctggctgggggtgggtgggtgctggctgatggtgggtgggtgctggctggtggtgcgtgggtgctggctgggggtgccgtgggtgctggctgggggtgggtgagtgctgggggtggtaggaatgtaggaatcaggcaggtcgagggtggatggggacatttctcctcaccaccagctctgtcaagacaagggtctcagaactgccagatctcaaggttggaagaaattacattccaaaatgtcaagtagtctagtcacaggctgatttgaaaacactcttctgttagctgtgccatgattgagaatttcatcccagcctgatggtagcaggaccacgattttcatggtcaactaatagtcgttgagccccttgtacatatcctgggctttctcatatttggtcctttcaagagccccatggtgtgaccatccatttaccaagagggaattgacagttccggaagattaaataatttccccaagcctacacggctaataatttcatgtcatgaatatttgttgaacacctcatgtgtgctggctaggcctgggaatgcagcagtggaaaggcaagctggattccctgtctaattctggggctccttccacctcctcttgcttctgtctcttccatctggcgaccacaactgaatacagggcttaaagaacttagagagatattgagaggttgggatataatcttatgagtaaatcttaatgatgtggttaatggtcctccatggggacaggaccctcccttgaaatgcagtttggaaacttgtgggaagacttttggttatcatcacaagcaatgggcactatgggcagatagtcagggggactgggaatgcatacaggatactctgcacagccaacagctgtcctgctacccacaggactgttggatttggtcctaccagacaccatataggtgaaaagtcatttataattatctgagcctagaacctaattccatattaaattcaaacacaaagtatttaggcagtgtgttagtcagggttcccaagagggacagaactaataagacatatatatatatatatatatgagtttagtaagtattaacttacacaatcacaaggtcccacaataggggctgtctgcaagcttgaggagcaaggagagccagtctgaggctcaaaactgaagaacttagagtccgacgtttgagggcaggaagcatccagcacgggagaaagatgtaggctgggaggctaggccagtcttgtcttttcacatttttctgcctgctttatattcactggcagatgattagattgtgcccaccagattaagggtgggtctgtcttccccagcccagtgactcaaatgttaatctcctttggcaacaccctcacagacacacgcaggatcaatattttgcatccttcaatcaagttgacacttagtattaaccatcacaagtccaccccttgttaacttgaacccatacacatctcctcagatcatacataatcttcaaataaagacaataataaggtcataattatgcctaacataatacaactatccttggtacaaccggaaacaaaccaatccccaacctaaatactattacataaagttaacaatatttaaatgctgatatgaagtcaataaatcttatgtggcatgataaaggaaaaggaaataaaatgaaaatattttcttagtacaagtgtataaatgcacaaacatgttttttaaccaaagaaggaggaaatactcatgacagttacagtcctcgtttctgcagctggtcacatggtcatagctggtattgatattgccttcttttactacgcattttgtattccctttgccttcagcaagcatctcagcaggtcgtggtttttttcctggtggagtgacccaaaccttcattcctgagggggtctgggtcacttgtagtcctgcctggattgggctgttgtagtttcccattgaccttaatcacagggcatggtaatactaagagatgtcctaatggatctcctgtattccacacatactcttccttgcctcctttatggagtagtagactgatttcatcttgatagtcggggtcgatcaacccagccaccactgtaactcccttcttagcttgtggacttaaaggtaggaggagcccaggccgggcacggtggttcacgcctgtaatcccagcactttgggaggccaaggctggcggatcacctgaggtcaggagttagagaccagcctgaccaacatggaaaaaccccgtctctgctaaaaatacaaaattagctgggcgtggtggcgcaccgctgtaatcccagccactcaggatgctgaggcaggagaatcgcttgaacccaggaggcggaaattgtggtgagccgagattgcgccattgcactccagcctgggcaagaagagcaaaactccacctcaaaaaaaaaaaaaaaaaaaaggtaggaggagcccaaagtgtccagatggcaatcttaactccagtttaatagaatcattgttgtgtctcctggtggcagtgttcctccctctggaactaagacctatatgccagcagaatgtaatggtgtgagaacaggaagcaaaagcaaaaatcatgctagtggatcactaggggtgatgatgagtggcaggaagcactttcaatatttgcttttcctccaaaccaccccccctcaaaaaaaagtgcaaccactgtgtcaattaagggacaattatactttgctttatttgaaacatttccgacagttgttaatcatttcaaaaaatcaagtcactgatgacaatggcaatcctacttctggcatttgagttgttaatgaaacatttcagttggtgtgttaggcttttctttcattgctataaagaaatacccaaaactggataatttaccaagaaaagagattgactggctcatggttctgcaggttgtacaggactggccccgacacctgctcagtttctggtgagggcttcagggagcttctactcatggtggaaggcaaagtcacatggtgagagaggtggctaggagtcaggggaggtgccacacacttttgaacaaccagatctcacgagagagaattcacttactatactgaggacagcaccaaaccatgagggatccactcccatgacccaaaccccttcaaccaggcctcacctctaacactgggattacatctcaacgtgagatttggaggggacatccaaactatatcagtcggcatgtatagttgtaaaatgcatggcaattctatgcataggtgcaagcatcagactgtccattttcattataaattattattttttattatactttaagttttagagtacatgtgcacaacgtgcaggtttgttacatgtgtatacatgtgccatgttggtgtgctgcacccattaactcgtcatttaacattaggtatatctcctaatgctatgcctctataaattatttctgtttgatttttgctttatgttacagttaggggactccagttaactttttttttttaattgaactttaagttctgggatacatgtgcagaatgtgcaggtttgttacacaggtatacacgtgccatggtggtttgctgcacccatcaacctgtcatctacattaggtatttctcctaatgctatccctccccaagccccccaacccccacaggccccggtgtgtgatgttcctctccctgtgtccatgcattctcattgttcaactcccacttacgagtaaaaacatgcggcgtttgtttttctgttcctgtgttagtttgctgagaatgatggtttccagcttcatccatgtccctgtaaaggacgtggactcattcttttttatggctgtatagtattccatggtgcatatgggccacgttttaacttttttaaaaaaaattgtgtacgtaggttcactatgaattttgtttcaacatagtacaaggggcattaagtggtatttgtcatagaagggcattggtgtgtgagaagttggggctggggccaccatggtagatgaaggttgcccacaacagaatgacaaagtgttcttcctcctccatccttggaggacagaagagtggaagctctgcttatgggatttgcagtaggcttggggcatgatttcctgggcaagaaagctctttgtctttagagtagataaactaatggaaagaacgctgagctcggagtcaaaagatctgagttggaatcatggttctgccacctccagatgttggaaccaggcaaaacttctctggtctttgtttctccatcatcatgggagccccttggaccagaattaggtgatcttgccatgtaacgtttgaatgcttcaaggattagctttcaagggctctcaagattgctttcccctctggaacagtcagtgtggtgggtctgaaggcagcgggtgaaagtgacaagagcattcactgttttgaacctggagatgccatcttgaaccagtaatttcatttctctgagccttcgttttagcccagataaaatgggaattatcatagtcctacctcattggggtgatgggatttaacaagatgacctttgcaaaaagtgctggaactccatagttctcagtaaatgttcgatgttagtttccttcctccaaccttccccagaccagttcccagcctctgcgcctctgctctgctctctagtccctcagtcccagtgccagacttgggagggaaggacttggagttgtgctgagtctcacattgtccttgcagggggagcagaggttagaagtcccttcctatccagggagtttccacctccttctctgggccagctgtggggcccatggagagaagagtgactaagatagggagaatttctggaggcctctctggccctgaacaaggctccacccaccaggaaaagcacaggaaagtgatttctcaatctggagactttggacaagggtttggccaatgttacatggagacgctcaccttccctttcagcaagtgccgaaggagcaaaggcatcaaggtgtaggactgtatggtatgctcagggaacgtctgaggacttgctggaatttacagtgcagatcagagtgaggggaagggggagccgggtggaggagctaagacaaggcgagattctgcagaactttgtttgccttgctcaggaccaactcttcacatatcaggtctgcggcagcaggagaggatggtctggttgcttgggcagtgttcagtagtccagtactgggaggatgaccaaagtgcaaagtccttttttttaaaagaaagaggccaggtgcagtggctcatgtctgtaatgtgagcactttgggaggccaaggcgggcagatcacctgaggtcaggagtttgagaccagcctggcaaacatggtgaaaccccgtctctactaaaaatacaaaaagtagccaggcgtggttgcaggtgcctgtaatcccagctacttgagaggctgagacaggagaatcgcttgaacccgggaggcagaggttgcagtgaaccaagatcgcgccactgcactctggcctgggcgacagagtgagactctgtgtcaaaaagaaaaaaaggaagggagggagggaggaaagggaatcagctggagaagagatgaggagcacattccaagtcaatggagtagtcgtccaaaggcccagaggtgtggaccaccaccatggtccggggacttcgagtggttatgagaaaggatggggattaaaagaagagttctggagtcagacaagcctgtgtgcagaccactgctgtgctgcctacgtattctcagagcctcaatttctcatatggaaaatggggatgagaattccacacaagcacgtgagctccgtgagagcaggcccctggctctctcattggcttctgttaggacaaggcctggagggcctggcctggggtgacccccctggctctctcattggcttctgttaggacaaggcctggagggcctggcctggggtgaccccttggtctgtgttggccaaaggagggattgatgaaaggcacaatgggcgttaagtgtatgggataaatcaacacccaagaataaagattcctttggagtgtggggcttcttaaagattccatagacgagaatgaaagggtggtggaaacctcggaagccagaaatagggacttttcctgtgaaacgtggggagccagtgaaggtctctggtgggctaagaagcccagcggtggctgggtgtaggcccctgctggggagtctgttgggcctgggcccttcctgaggtggagccagccgttccccaggaagctccctatgcgtcatcgtcatggggcagtcagggtcttctggaggcagctgcagcccctctagagacagcctgagtcaggagttgggaatttctggaggtggccaagtgtgggcccctggggttgttccctgggactaggaaggagctcccaccggcctgacttggagtcatgggatctgtatctgcaggcccacaggacccgtgacctttgacctttcatacaacctgaccctttgaccccagcaggctctactgtttggttttctggggggaaaggagagctcaggcagagatggagaggggcagtgctgctgatggaacccccatatatacatcttcctcaggggccccgaggggctcttcttggcctctgctgaggttctccagctggctcactgccaggaggaagtccatgttgtttgggaccaacccctgacccttctggtggtttcagtggttctgggggaggctggagctgttccccagagtgctcggttttccctttgctgcattctggggcttccactcacccccgctccatttctctgcttcccacacacttccgccagagaagccggccccccatgcatgctccccatggtaaaacatggcattcaccactctgcacttcagccttgccccaccatctctgcttcaggaactctctgatctcctgtcgatcagagatcgacaaggagccaggacccccagaaggaggttaggtgactggccgagagcaggggctgcttgcttgtctgcaaaataaaagaaataggatgcccttctggggtggtgggagggtgaaacaagatgaggcctggacagggacagcagagccccggcacgcggcaagtgctcagaacaaatgcggtgagtcgtagaaggagtagcagaagcagtcattgtattatagtttttgtgatttaatgagtcattttaatttaatcgcagctcagacccacaaccttgtgctgagggggctgaagggaggctggggccagaggcaggccagctctatcagaggtggctccgtggaggaggacagctcataaatgagcaagattttggtagtgaggagagcaaatgtttggtgagaaggatggagacgaatgttctaaactgagtcagtgaccagaaacacagctctcagtggttgcaggatatcgacctatatttagagggcacaggcttagcactttgcacacagttggtgcttaataaaggatggctgctgttcccagctttaccctcagtaaggattcacagtgagggctcatcaagttcaatgcctaggggactcgtagtcatgtactcactcagcaagtatttattaagcatctactatatttcaggcactgttctaggagttggggatgcaccaatcaacaaatcttgccctcaagaggttatcatctaatgaggaagtggcagataataaacgaacaacctagagaatatgtagtatgcagtgtttttcctcagagaaggatcatttatgctttaaaacatcagaacatgcataaagcacttagagagtgcccagctgacacatagtaagtgctcactaaatgcttcctattattttagctctggcctcaccagtctgagtgtaaaccatcactatggccatcataaaacaagatttctttggctctgcttccactgtttaagcattttagcccctgcaagcctttcctcaacggctctgagagggcctgtcacaaggtctcccagaatttgtcctcttggcaaacaagtggcattattcctcctgttctgattctgcaactctgactgaaggtggtgatatcccactgctgtcaacaccctctgccaaggtcaccaccagaaactgcctataggccagttctgccgggcacccacagaggcctgtacgcgactgacaatggctgagtcagagacacaccttgcccaagagagctgtcccccgatctctcccatgaccacccgcacctggactccccagatcccaggggaacattggaggggcatgccttgtttccctaccccacccctcttctttaaaaagcactttcgcctttcccctggaattctgagttaacttctcagggccagagcagaggccacttctgagtggccctgctgccatttaccactgcactgcaattgcgcctgctaaggtcagtgacctctaaaggtcactgctccatcttacctaatttgacctacagctggtccattgctcctccttgaaacaccccctccactttggctccaggatgacacactcaccagcgtccctcctggcgtcactgggttacccttcagcttcaacaccggctgggggctgggggctgggggctgggctcagggctcctggtcctctttttctccctgcctgcacacacaccttcattcctttgttgctctaacctggtgtcatggtttgaaaacccgcagctccagattcacatatcagagactgctatgaggtgtctcccctggatgtctgatgggccttcaccctcacagttccagaactgaactcctgatcttctccccaccccaaaacctgtgccttcctcagcctttcccatccaagttaccttaggcaactgtgccttagaccccaaaccttggagtcttccttgcttgccccttctctcaccacccaccctcacacccaatcaaatccgttaacaaaccctgtaatcccaaggtccagatccctccagaatccaaccatctctcacccttcgatgcagccaccttctagctggctttctggtttctgcccttgccctgtttcagtatattctcagcagagcaggatgacactgcaaagtgtaggtcacccttctagcactccaccccatccagtggccccatcccacaaagagtctaagtcattgccatgtctgacaaggtgctacatgatctacacccgctgccacctgtacaccaccgttatttctcagacctcatccccatgatgcagaaggggtttaggcaataagagctctaatagatatgaagccctggctgtcgtctgaacacaacaggtgtgctccaagttcgaggccattgcccttgcccttgccctgaaacaatcttctcccagatgttcatatgattccgtcccacacctagttcagatttctactcagatactgctttctcatagagggcttccctggctgcactgttgaaacttgaacccattctaacccatggcgttctctgtccccttctcttgatttatttttctctgtagctcatctcccagctaacatacaatatagtgatgtatttatgtgtctgttgcctgtctccaaccacatcgatcttattcaccaccgtgtctctagcacctagaacaggacctggcacttagtaggtgcttacagaatgaatttgtaaaagataccactcttgatattgaccctacgtctaccctccttcaatcctggctcatggccttgaactctactagtaggcactgactcctactgcacttagggaaggcatcagactctcattcaaacagacccctatctagccctgactcattaccatccagaggagcttggcatgctaagtttgacctggaactattctcctcactcttccttccaaccacagttcagtctctaccaaatgaatatttatcattgccagagagggctgggttagagtttagaccaacagcactgcaaagcagggatcttcagagaagactaatgccgtagactgaatgtttgtgtcccccctacaaaatgtatatgttgaatttttgttgttgttgttgttgttgagatgaagtctcattctgtcacccaggctggagtgcagtggtgcgatcttggctcactgcaacccctgccacccaggttcaagcaattctcctgcctcagcctcccgagtagtttgtattacaggcacccatcatcgtgcccggctaatttttgtagtttttagtagagacggggtttcaccatcttggccaggctggtcttgaactcctgacctcacgattcacccgccttggcctcccaaagtgctgggattacaggtgtgagccactgagcacggctatatgttgaaacttaacctttgaggtaatggatttgtgtgtgtattttggggtggggggggggctttgggaggtgattaggtcatgaaggcagagccctcatgaatgggattaatgcctttgtaaaaaagaccccagaaagatcccctgatgcttttggcattcgaggacacagtgagcagacagtcgtctatgaaccgaaaagtggaccctccctggacaccaaatttgccaacaccttaatattggacttcctagcctgtaaaagtgtgagaaactgtgtttatgagtgcctcagtctttggtaatgtgttacagctacccaagtggattaacacagccaagcagggtcagctattaacagagagggaattgggagcgggggcaaaatgtcccagagtttcaataagccccagagggaaacccaggaaacagaacccaaaagtatcaccagaatggagttttagtcactagctaagccagaaccgtgccatgggttggctcaggaaggccgagggagacagaggccacaggtgttactggggatacctggggcagagaccaggggcttctaatgttccatcgtagttggccccatgccttctaccttctaggggctaccttcgttctggtcgaggataagacctgagtccatctccccacaactgcgctgtccccagattggcaagggcacttagcaaacagctcagtctaaccaccttccaagttacatcattatttatctacatggcagataatgtttctaaattttggctggatgcatgaaataatgaatgaattctcccatgctccactccaagaaaaggaagaggggaagatcaactttttactgttgatgtaagatactcttcactgaactctgatcacacccttgcccccgacaccctttcttggttttgccattttctctaaggcagttgttgtcaaccttgttttattgatgaggaacctgaagctcagagaggttgctgtctgtacaaagttatacaacttacagctggcagaaccagcatttgaaaccagatctgtctgaccccaaatcccatgctctttctcctgggccaccctctcttgaatgaagaattataagtatctactatctgttggccactgcattaagatacctcaggtaggttgttctagttcattcttatattatgagactcatattaggcccttgttacaagtgggaaaactgaggtttggtgagattatctacctttcccaaggtcatccagcgtctaaggttcggagctggattggaacctggctttgtttgaccccaacaccaagctcttttcactgctccacaatgccaggacacgaggccatgtccaggctggtggactcttggtgatgagctcaggctgccaagagcaaggcttctgtttgcttcacccttgggatcattagttttatgctgctccagctttgcagatagtggccagtgtacctgtactgaccaagcccaggcaagaatcaggcatgagtggacagggcaggcccaggacaggtcagtctccaagtctggagacacaaggccaacaacatgcctctccactgacactggtgcatgagctcatcgctgggcgctggaacccactcactgcgtggttattgctttggtgtaaagaattaaatcttagcagcatggtgggtggttcagagctcagactctggagtctcacatcttgggttcaaatctaggctactcattggctttatgatttttagttggttccttattccttctgagcctcactttcctcatctgtaaaatagggttagtaatagaacttgtcttatagggtcatcgatcagattaaatataataatgttgataaaggacttacaacaaagcactttaccggtgtcccatcaatagcagccccaattgtggtaatttttaaatattgatgggatgagaaagacagaacaattcattaagctaccaatgaatgggaaaataacacagacccatggacatcacctcccaatttttttgttttgatttgttttgttttgttttgtttttggtcttggaagaacactggacctgaaatctgaggattcaagattcaacttcaaatctggctgtgtgacttctggcaagtcacttcgcctctctcagtcttgtccgacttgtctgaaaaagaaaaatcgtgctattgaactgctctacttagccctgggattcgcatgaggctcaaacaaaatggtgttgtggaaatattatgtaaagtagaaaatgcaggagaaatgctagccattgtgttgaggtagttcccctttcttgtcccccaccccacccaggctccctccagccagggagtctacctcccgccctttttggctctcagctgccctggaatctcagttggctcccagaaagcatttggagcacagcacaaattgtctaaaggttgcttccaaagcctccggcggctaagcctggccccagcccttcctccttgaaaatgtctggcttaatgggaaagaatgtgggctggcaattcagtcccattcaagtccacaagcatccactgaccacctgcaaatgccaggccctgggccctgggcacctggggctgaacaaggtagtctctgccctcaggagctcatggtccagttaggaaacagtcatctcacagacaaccataacacatgttagggtagcactggactgggggcccagaggaagacactgtacctgtgctggaagaatcagagaaggcttcctggaggaagggacatctgagaagagcccaaccctcacccagtcacatccaaatatgaaagccttcatcccatggtgaagccttcaccacactagcacctcctcatccctgtggtcatgggtttgtccacgctttaagctaaaggtagctttaaaatattatttagtccagctgtcatttcaaagagacccagagagctgaagtgactttctcatggttacccagctggatctactgaaaatattgggcatcttttatgtgaagattaatgttttcttcttggggatccatttccaatcagaccaactgtctgggaaagggcaccagctggtcataaaagtcaacccaaagggggattcttggagctccttttcttctgccccttaggctgcaaccgtggacctgatccttgtgcagcatctcacagtctatgtgggctcctgcaacccgctcagtcctcatagcaactctgtgaactgaccgtcacttaacttgttttacagataaggaaactgagtttggacaacaattcttaagaggtgactatgaaactgaaaaattgatttcaaaagtcaaagagccctgagtcaacatccaacttcaaactggaaagtcaatttcattacttaggagtaactgtttccttgtcctctcctcttttcttttataaaattgccttctaagcagcaggaatgactggtcggcaccacgctggctggagcgtcttctctttcctgccttttgatcctgcctctgtcctcctcgctctcttcctggctttctgcctctattcctgtctgcgtttctttctccatattgcttttttctcccttctgcctcttattctctccccacctctgtgtttttctctgctctctatctgggtgtacgtgtccgtttctctctctgcctctgtctcctctcttccccttcccctcccaggaaggctctgcaggtacttggaggtgccaaatacctttgctgtgactaacccagggccgtgcagtggctgcgtcttgcagacctctccgagtttccagtcaccagttcccggagcagtgggagggggaagctactgagggaatctgacaaggcccctgcccaaagctgcacattccctggacaagaaaggaaagaggattaccagagaagagacaaacaggaggcattggtcagtgacagtccgccatccaccccctccacccccgaacatctggtttgaagacgggtggagtcccaccctccagatgtgcggcctgaggctgaagcagctggcaggaaagacaggcggtgacttcacaacccacttaagctgggggagctgagggtgtgcatggggaacaggagccaatatcagtgaaagcaaaagtccaggctctccatctgctctggatgggaagctgggtgctgggagcgcagagtttagagagagagagaccctcatccctgctggctggattcaaatcctggctcctcctggttcctagcagtgaacttctgcaccactgattccctttcccagcccatcattcctaacccgtcagaagagtgccgtttcttccctcacagagccatcctaacattttgataaatgaaatcacttctctgaaatgcctagcacagagtgctgggtgccccgtaaacattgctttccttccttcaccttccagaaagtcttcctggacaagcccgactccccggctctcccactctcctctctctgctccctgccggtctctgtgtgtcttttctgcctgggtctgccctcttgtcagaccaccctgctgcgtgggcaatcgcccacaccatcattgttcctgagcttgcccttggtggtggtggtggtggtgttagttctcagcggggtttctgcccaacatcctgtctccttaccgacacagtgagctgcttctccgggttgacagagtcctgcggtaagagagagacactcacagtagcatgttgggtgaaagcatggacttgagggtccactagacccaaatttgcatttgaccgtctcttacttattaacctgtgaaatgaagataaggagaggattgggttctgaagattaaatagatgaatttcttagcacactaggccctcaggaatggtgacatttagctattattacacggcctgttagctcactcgatacccagcatactgttaggtaagaagcaggcattaatgagtagagctggaataacagggaacggctctcatagatcgcttcccgttggtgatttgtctattacaatttagcttggactgggctcctgggagtgcccagtctctcagactcagaataatttctggaatcatctaggtctgccatccatttccacattttgaagggaaaaatgagtccccaacgagggaaagagatttgcttaaacttctggtaaacacgttcatagagttgtttgttctctatcaaaatgcagagaaggtagcatctgctcttaactcctgagggcactgatgtacaagccactctctacagtaggtttgcactgagaagggggagtgagagcaaggggtggcctgggcacgaaaggggtcatcatctcatgaataatccctccacccggctggtgtggtacctcttattctctctgaaaattcatttgctcaagatcacgcaggtagtagtgatgagtcaggattcaaacctaggtctgtttgagtccagagctgggttttccatgacacctgtagcctctggagggaaacagttgccaccaagatgaaaaagaggcccccaaaaggaggcttggaccccaggaagaccaactcattgccttctgcagttgcctcaggccgcccagtctccaggagggaaggaacaggagagggaggagatgttgacctcccaggcgggccttcaagctcatctgtgcaaattagagtccaaggggagaggcagctaaagacaactgtcacctgagccccaaggatactgaccacccaccctatctagctcaggtgggcaagtggctggtgaaattgctagaacttacctcttcccaagacttacctcttcccaagcaggtgggcagcaggcagcatggacggttgtctcagccttcagcgtctcctccacctctctctctccctaatgctccctccctctcctctgtctccaacctttctttccttcctctgtgtccactgcccctggttagaagggattctaggccactagctggctcggggcaccaggatggcccagaattgtctgcagaagccagccaagggttgttcctttatttccgttctgctggtgagacattgaatgttcagaattggagctgggatactaggcatcagatgactgtgacatctcacaaggccgcccccttccccaccagggcttaggcatccactggcaacttcctagatttcccaaagccacatatgaatcatacatttatactcactcagggggtaactgaaatagctagtgttaaaaaaatgctgattatctcatattgatcacttgattggtaattggagcagtcttcaattacttcaaggttttcattgatttgttattattcactattattgaatggacaattcaccatgttactttgggtaagttacttactttctctgatttcttccctataaacggagggcatcatacgtgatagggtcttagtgaggatttaatgagctaatacttataaaaggcttagaacagttccagggaccttatagctattcgtgtgagctgtttttgttgctagtgttgctattaatggcgtgataagacggaatattttaaagcatactatgcacaatggggaaagttgttaataacgtggacttctggttgctgaggagaaaacaaggccaaggaggtgaaatgggaaggctgtaggataaaatggaaagaatatgggctttggactcaggcagagctaaattcacatcccagctcatgtgcttcctcactgggtgaccttggctgaattgcttttctactctgatcctctgtttccttgtctatagagtgagaaagaacatgtctgtgcctggcagagactaggtattcaaacagcagtgtccttggtgtaagatcctcccttcatttcccatcctctcccaaccattcttttccttgcctccactgccaagccagcgagtattgaagctctgtgttgagccaggtcttctgtcctgttctcttcttttccagagatttccatgagatcctataagaatccaagctgagacctaggagtcattctgggctgtgtgactaagggcttggtgctttattttgtatttatttacttatttatttatttatttatttactttgagatggactctgtcactcaggctggagtgcagtggtgcgatcttggctcactgccagctccgcttcccgggttcaggccattctcctgcctcagcctcctgagtagctgggactacaggcgcccgccaccatgcccggctaatttttttgtatttttttagtagaggtggggttttaccgtgttagccaggatggtctcgatctcctgacctcgtgatccgcctgcctcgggctcccaaagtgctgggattacaggtgtgagccaccgcgcccggccagggcttggtgctttaacttcctgtctggaaaaatggaaagtgttaaactagaaaggtaaatacttgggtcaaataactaatttcctctttgccttatcttagttaagaggaagagtttggaaccctttggcttgggacatttgactgtaatctgattaataatagatgtttgggaagatactagttaaagagaccctatgagaaactgatctataaagtgaacactgtctcccactaatttcgctattgacaaaggtttctactaattcttagagcttgtcctatgaggaaaggcacagattggtatggtatcgtgtttaagaattgggctttagagggcaagcacgatggctcacgcatgtaatcccagcactttgggaggccgaggcaggcggatcacgaggtcaggagatcgagaccatcctgactaacacagtgaaaccccgtctctactaaaaatacaaaaaattagccggacgtggtggcaggcgcctgtagtcccagctactcaggaggctgaggcaggagaatggtgtgaacccaggaggcagagcttgcagtgagctgagatcacgccactgcactccagactgggcggcagagcaagactctgtctcaaaaaaaaaaaaaaaaaaaaaaaaaattgggctctagagccagaatgcttgggtctgaatcccagctttggcaccttaggcaagttgcttacctctgtgtgcctcagttccctcgtctgtaaaataaagataataatattactgtgtgtggctgcatgtggattaaatgagttgaccaatgtaaaatgctaagaacagtgctcatgtctgtaagtaccagcctattattgtcaactctgcatctcccagtgttttgggggaagacatttggaacctgttcctcatgccctgatccagtgtctcccttttctcagccatctggaaataaaattaagccaaagcctaaatggtaacatttatctacagtgcccaccctactgtgcctcaaaccttcttttgtccccattgcctgcagcccccacgggactgcgattttcagttctcagagaagcccaaggttggaatggaccatcaagatcacctcatttgatccttctttggatactgggatctgttggctaacatcccttcaaaatagccctcccatctcttctcgaatgcctccagtggcagagagctcaccacctcctgggcagcccacctcatctctgaatggctgtaattcaagaaaaggtcttcttgaactgaactcaaatctgagcctgcaaaagcatcccaatcagatcatttccctgttagttaactttcagtctttcctcattgaccccagggttatgtccaaactcctaagacatctgcaatttccagctgcatttctgcccccaagtctggtattccagccacactctgcgtctcacctgtttttaaatgttgtgcatccttttacaactctgctattttgcatatgctgttccatctctcttcccttctctgattggcaatctcctacacattctctaagattctgatcaaaactcttattctccaagagcgtgaccagttccctcaaagggtttcagggttccattccccaagcttctccagcacctctcatttttgtgctgtaatcatctgttgatgtgcccatctccccagtgagtggcagctccttattcatgttccacattgcacctctcgggcccagtttagcacctgcacagaacagttgtccagaaagtatttatctagtgaatgaacaagcaccaaattggctgctaattacacctgttggtgcaagttccattttgagtctaaccctcttcacacacctgcccttcaaatattagaagacagttctcaggtcccctgaatcttctcttcaccaggttaacatccctaatgctgccagcatttccttatatgatgtggtttcaagtcattctttacctctgtcactctcctctggacaattccagggatttagcatctttctcaatgtatgtcttccaaagttgaacccgagacttcatagtggtccgacatgtgtagggggtgcagcaggactattcttcacttgttctgggcttgacgtggctcatagcatgaaaagagcactggcattagagccagctacacatgggctcaaactaatgttggcatccatcagccatgtaactaggggtaatactcaaaatatttaacaaatgacatggttcaggaactaactagtcaattacagctttggagcacagtaaaaaagcccctgctgtgcctgatgttatccttttggtttttggatcatggggtagaggtggaggtgggggatcagggaagcagctaattctcaaccaacacacaatatctgaacattttaacagctggtacagccacacctgtgtggaccaggtagatatcagtaatggatacaaccagattaaagtaacttcagtgctctgagcctcagtttcctcatctgtgaaatggagttgaaggtagtagccactgctggggactttgaagggacactgtattacttcattttcacactgctgataaagacatacccgagactgggtaatttataaaaaaaaaaaaaagggggggtttaatggactcacagttccatgtggctggggaggcctcacaatcatggcggaaggcaaaaggcacatcttacatggtggcagacaagagagagaatgagagccaagtgaaaggggaaaccccttctaaaatcatcagatctcatgagacttatttactatcacgagaacagtatgggggaaaccgccccccccctgtgattcaattatctcccaccaggtctcttccacaacacatgggaattatgggatctataattcaagatgacatttggattgggacacagccaaacccatatcagacacaataagtaacatcccctctttcctgccaaaatttcaaaccaattaagaaataagaaaaaagaatgagcagatgggaaagaaaatatcacctttattacataagaaaagttaggctggaatattcagcttatatctgcaggtgagtgggctcctacctgaatgcaggattagacccactcacctgggaggtcccagactctgctggtccaggagggcctccctcaccacctaagtctccagcctgatctctgtcacacactttgtgtttcagctacactgagcttttaatgatcattttttaaaatgctaactcctctcttctgataatcccatgtctttgcctgctgttcttttattctggaatgttctgttttcccttctctggctggcaaattcctactcatgcattaatacttggttcacacatcccctccaccaaaacctacccctgcctgtgaacttcaagtgggagcccaggatgtcattcctaagaacaacaggaagccaacagggaataactggaagggattcatttttacaggaaatcagatatcaggaagcactttcttcaaattcagagtcatgcagcaggagcttcatcttggcgctttgcatttgccagtggggagagggaaggatcccacctgtcaatttctttttcctctttgaacgctgtgtttcttgctcattgatgaagtaagtctgcattctacttagtgacatcgtgttcacactcatgggaacaggcatttgtcaggcttgtgcctctgcaggtgttatctctggtagtagagtcgcttagggctgagaatcctgcctcccagagagagtctttccctcatatgttattaacaaacccagagccctcttgaaaccacacatctgataagtgcaggtaagcgactaaaatgtaaggacttggcagatgtggagtgcttagcatagtgcttggtacggggtcaacgttaaacaagtggtggtagctgtggttatgatgaccgtattactaccaggataattgataattagttgctacaacagaaaaaccctgggaatctcagtggcttaccacaagaagatgtcacaatgtgagatctgatacgggtcaggcagtcctcctgcatctggccaccacatcctctggagcgcatggcctccatgatcagcatggcagaaaagcagagcaatgtggaggaggcacatcagctctgacctgcccagaagtgacatctcaacccctttgctcatagtccatttctcagaatgagtcagggtcctggtcctgatctctagggaggatgggaagtggagaggagcactgggagatatggtagttaataccgtctctgaaaccattatttaggtggacaggaatagatatagctccctcacctcctttgaaaaggatttgagaatgagactatgtatagaaaagatggacatggatgaagctggaaaccatcattctcagcaaactatcgcaaggacaaaaaaccaagcacctcatgttctcactcataggtgggaattgaacagtgagaacacatggacacaggaaggggaacatcacccaccggggcctgttgtggggttgggggagggggagggatagcattaggagatatacctaaggttaaatgacgagttaatgggtgcagcacaccaacatggcacatgtatacatatgtaactaacctgcacgttgtgcacatgtaccctaaaacttaaagtataattaaaaaaaaaagaaaagaaaagatccagaagaatggctcagtcacatcacttagcttcaccaaccctcagtttcctttttagcaaaatgaggagaatacaagtacctaacctcatgggttgttttgaggtttgggtgataaatatgacagtctataagactgagctgacctattaagactgttctataaaaattagttggattgggagctcagctccaattggccctttgggtctacaccgtcactgaacattttgaacttagcacacacaaaaattctgaactgttgtttgcaattctcccctttctgtttttctgtggctggtgttttggacccattgatttatgttcagagaggtctgtctgcttgcttactggtatgcctggccctgagctggtaaatgtttagtgaaaaaagaataggagagcatttgaagaatacacaggcttcaggcaagtaaggaaggggttggtggggtctttaggcccgttttaaaggaagtcacatgatatgctaggaatctgagcccttagattctcaaaatattctgctgcaatacaatataatgctggtcaaattgtttccattcctgtctctgtttctcagtctgtaaaataggagacagtacagcatgattcttaagggcatagattctggactcagattgtcttggttcaaatgtaggttttaatttttttgcccattgcctgttttgggacaattatattatcattcctgagcctcagttttttccatttatggtctcataagatcattgtggggacccagagaaaaaaaattatacaaagcattaacactgtgtttgtctgacatgaatccacaatgttggataatattatcaaaataatggggtaagtactctacactatgcagtaacaaaagaggacaaactgttgatacaagcagcaacatagatgagtgtcaaaaacttcatgctgagcaaaacaagccagttgcacataattgcacttttatatgaaactctagcaaagacaaaattactctacagtggcagaaaacagataagagattgcctgggatctgggatgactacagtgggcatcagggaatttcgtggatgttagaaatgttctatctcttgattgtggtcatggtcccatatgtgtatccattagtccattagtatttcatgtgtgaaatctgaacacataaaactgatgcctttattgcatgtaaattatactccagtaaagtcgattttaaaattaagaaacaaaaacacaataaaatgagagggttgaactacatgagcctacctctgattctaggaaatcctgccaggcatggccccctcctctccccaccaaatagagcttcctgggcaggagccccttgctgccatccccctgcctctgggcctcttcctccacaagtcctggtccctttctctgccctcgggtcagccagcttaagctctctgctttgtcagcaaaccaacataagggtgcaggctggagtggttcaagttcccagacatgagtgggagcccaagatattagctcataaaaggatgaaaatgtcaccagcctccctgtgggctgggagacccaatgacctctctggctgctaggggctgctgaccgtgtttcaggagtcagcgtgggaggcctcagggcagtcagctgatggtgatgcttgaagatctgtcatgttgggactaagacagatccccttctagataatcagaatttccagagccgtcaaattccagggctggatttgcagggaagctgggggaaaaaacaaacaaacaaacaaacaaaaaacaaaacaaacaaacaaatacaggaatgatgttccagcctgcactaggtcattcgtacaaattattttgcttcccaccgcaacattgtgggcttgatctgctaatagtagtgatagtaataataatagctagcattgattgagaatttactacgtgccaagtacttccctaagcactttacatatattacctcagctaccctgtcatgtaggtgccaccactatccccatcttgctgatgaggaaattagggcacagagaagatgagttatttacccaaagtctcacagctagaaatgcagatatggggcttgatcccactccatctgatccaggagcctgccaaaagccttgtatcctgcccctcaacacacacagagccagggaccagaaacgaggatctcagtaaacacttccacagaagaacccattggtggcagtggaggcagatggagtgtaaccacctctcacttccacccccaaatcctgcgcaattgcccctcattgggaagcctaaatcacccctggagccttagctcccaaaaagtctaggtatgtggatttagctttttgtgatccttccaaaacaggtaggcacattagaaggagaatagaatggatgccgaagactgtatccaccctgagaagcaacattgaattggggagagtcaaaggccatgagggatacacagggtattaggaaggactcctggataacaggtagtagaaaccagtgtaagcatggttccatgaggatttagcccaagacctagggggaatgtcctgtggaatccagaggcacaaataaacccaggaatgtcctagaatcagcaaacactgtcaggactttctcttcatctcggatctcagccccactctgtgtgtcgtctttatccttctctgtccctgcagatggggttccgctgcttcccaaatccatgcagcaggaagcatggcagccatcacagggccatcctcccagggcgatgtctgtctgtctgtctgtctgcctgcctgcctcttctctgctcctccatcacccattccaagttctcagggaagagacctggttaaccttggatcagtgtctctgcccccatccctcgggtcacatgcgtgaaggctggggcagccggggatgtgtacaaaacagcagctgcccatactctctcccccctgcacctggagatgaaggtggtggttaagatgatagagcggataaggttgttggccccataggctaagaacaccctgtaagatatatcctgcatgcgtgtatccactcatactgttaaccagcctaatcagggctcaggaagttttccgattgctcccacatgcaaagaggcctccaagctgctgacactcagacaccagatgagggattgcctctgtccacccaccccaggccctttaaagcagcagactcagctgcttaatacacccacagaccatgacagcagtggccctagacagtctgtttagttctggaccttttcttgctcagattgcctctcctttagagtcttggctctttgcttggctcagcctggcttttggtccttttgaataattgtcagtccttggtttccctggtgtaaatctctgtcctctccaccaggctttgactaagtgtggcgctgtgatcctataatgcccctccttgtccagagtgtcctcatgaaggccactgcccattacctcaaaacccaccccccagctcttatcagtcagcatcctggctgggcccatctgagatgtctacactgagggcttcaagagcatcacatgaactttcagccatttgtacttggccaaactcttgggccttggttcagcattttgtgagtttgggctccacaccaacccctctgccagacactggaacacagagatgaataagataaggctgttgccttaaggaggccacagatatggcaaagactgagctccgccaggcgccggccatgttagacatcagatagaaaccaagagccagctactaggaaccactctcctgggctcagacagccagaggagaactcacaacagcccagaatgtcagagataattctgatcctggaataggaagctggaagataagacgtctttgttagttcctcctccatgggtacaatgaggtattcatgctgttcccctcaggacttgagcagcattttaggcccaagaaatatctatgcatcatcataattgtgtgatatggctgtcctctttccaccccaccccttgacaaatcctggttgggtaagataaagttctgtcgatgctgatgctgctgtgatccccttcaatcaaatttcgctttgtggcattagatttagacttctcaagagttgaaaatctgggagcctcttccttccattgcctttgccccccacactcagccactgtgtaaagggatcagccaattctccaagtgctccaggggcagactttattgaaagataccatggcatggggagaagaacatgactttaaagtttaactatcctgagtttgaatcacttatcagctgtgaagacctggacaatttttttaacctctctgaacctcagatttttgtcttgttttgattttttccaaaggataatataagacttatggaaatagctttataaagttgattgcaggattcaatgaaacagcatatgtaaaacccccagtgcattgcctggaacttagtggatggtcagtaaatatggtttccatctgtaagttctaagtacgtctggtgaagtaaatgaacatggttcccaccttcaggaaccttaagatctttagtgactgggctcacctgtgtgaaacatcatcatctgtcaagcaggcagtaatatttacctcataggatatgtagacactgttaatcctcactttacagatgaaattacgatgtccagggagattgaatgactcatccatggtcacagagctgggaagcagtggagttgggatttgaacctgtccttctggctccagagcccatggtcctaccacttcactctgctgcctgcaccatcttgctgagctaggttagtgtggggagtcaccaggaagctgaaggtagtggaaagggttggatttggagttcagcaggtgagaatctgacttcacaataatggtgaaggtactctgcttcttcgtttggaaaattacaccaataacaaccactgcctccagagttcttgagtagatctgattaaatccattggttcagcaggcttgctgtgtgtcgggcactgtcctaagtgctggggatgaagctttgagaaagaccatgatttggccacaaatgggtccctgccttactgtcaaatgagagaataagatctcattgggaatacttcccaaacagaggttcaccattagtactaagcaagtgaaggtgcttgcatctctacagggacttagtacaaacaaaacaacacaataataaaagcaataataatgagcatgcattaaacattttttgctgtgctgatcacgatgttaagctctttgcatgcattttctcagtcgcctcaaaacattgcacataggccttataattgatccctattttacacatgagaaacctgaggcccagagacattgttggttcacagctagttgagcagtgaagctggttttccattgtaggtggcctgctttcagagccttgagttctaaatatcacaccatatggcctctactacatcatgctactgcctctgattgcttgcctcttggtgatatatttagaaacatttggaagccttgtaaagggctttgtcattaaccgtggaggatttagcccacaagtctctatacctggtcttgatcctgcatctactatagacataaagacagactttgggctacaggctggggagcaacaccccatgacacttgctggcaaggccccacagccttggtagttacctcaccactggccttgacatcactgctggccaagccaagagcctgggttgtatcttgcatctaaaagcctgatcgtaggcttttatgaagctgtatctttcagagaacttcctggatatgacctcacttgtcctccatcagcttccccagaaagagcggctggcagcttcatcccagatttatagattgtggagctggaggtgtcagaaaaaaagttactttttctaggtcacccagtaaagttgggtgcaaagatgcccccaacccccaagtgtcctgaatcccagtcctggcatggcatctgaagccgtaatggccagagaactgaaatcacacaccaaagggcagctcttgactctcaacccaagactctttcccctgcgtggcattggagtcattgtttcactgaaaatacatttattgatcacttactgtatgccaggagctgggctgagcactagggatgcctgggtggatgaggcagatatgtcctgctgttgtggagctcataggccagccaggtgacaagcaatcacctctggggtgagtgtcatggagagaaaagcacagggactctgggaccgtgcaatctggtgacatgccttgtccagggggtcatgaaaggccatcctggaaagtgatgtttgtggtgacacatacagggtgacagaatgttgcaggtgaggtggcagatgtgctccaggcagagatacagcatgtgcaaccagagagggcactctagaaaccaaaacatggcaaaagggagagtggcaagtgatgtgttgggtaggtaaaggtaagacacggaaggctttgagatctgtattagttctgtgtgctttgtaacaaattatcacaaatttagcattgcaagacaacacccacttattacctcacagtttctgtgcctcaagagatgccagaacctgaatttttcagcaaatcctgaggaagtacaccattcaggtcgggatacttgataagcaaactcacaatattattgtctgtaaaagtgagatgagaaccttaagtaacacttagaccagaatcctcttgaacacactgtcaactcatcctctcccatcaagttatgtaggaaatcaaatggagatcagaataccagtctattgattcatgatgagaaaatcagctgaaatgggaagatcctggaatctgcagtgtctagcccattctaaaggcagaagcacatgggaagccagagcttacccaggtggctgctcagtaagccgagtgtcgaagtgatgggaaccaattaaagcacatgcttaatggtacccgaccattatatggtctgatgcagccacctcacagtaggtttagtcaggccaatgggatgaaatatattcaaggtgtgcatttagtaaatggtagccaccattacaatggttattctttgtcttagccaatgtccttgtctaagggcggtagactaggtgacttctatagtgctgatgtgctctgatctcaagggctattattacttatctagggaaatagtctagagtctgcacattgccctcatgaaaatctaagcctttatcattgtcatccatctcgtgagcattagtagtagtattatagaaagcagtcattatctatgaacgactgcctatgtttagggcacactattaagtactactaaggtttactacagcccctatagggtagttttatcactcgtattttgtagatgaagaaagaagaaactgagggtcaaagtggtaccatcatttgcccaaggtcacccagcaagtgaatggaagagaagggattccaatgaccttcaacacaagccctagtgaagcacagtgaaaatggatcatacttcacatgcctgctgagcaagtggatgctgtaaattcaaccttttctctcccactcaagaaaatagattagattgcaagtcagtgagagtgatgtcattatgggggtaaccttgaacccactctaatttattaaaagaggaagtatttgtacaaacatcagtactcttactaatacagtgactgctggcttggaagtttctaaatgcgtggtagcgggacttcagtccccatcactgtagttcccagttactttggaggatcccctgaaggtgcctcccatctgcccacaaagcaggtgaccagctgtaattatgtgtgggtatcagcccccttcttcctctcccactggctctgtctgcaacttatccatgtccatcatccacatggagtcaactgtccactgaatcgggatcacgcttttgcccccacaccgtgaagtagtacattcattcattcactcactcattcgtttaatatttattgaggatctgctttgtgccatgcactgctctcaagcccggaaagaggatggtgacctagaatgagaggtccctgttcttgtatagctgatcgtctagttgtgggtagggggaacagacaattaacaaatggatagctgaataaatgagtaaaacaacttcagacagagttcagaactaaaaagaaaataaataaaactgtctggctggagaagcactagttaggatggggtaaccccaccccacgtatcctgggcccaccgttgagctcactggcaccttctgtggtcagttcccaggcatgcagacagacattgctttcctgcatctcctcttctccttctgaagactttctctggtgccacaggagtgtgctctgcccacacacagggactgactacccaccgcacccccagggcaaccttcaacccatgagggcaagagcctgttggataaatacttcaactcctctatctcttagtgggacaatttggaggcatgtttcacaccatacctcaggggtctccaacaagactgagtctcagtttccctcaagggtaaccaactcagtaacacatcctgttaacacacccatctgtgtcatactttcatgactcccccaacctcttgtgctccctgagattgccttgcaaataatccacctataccaagtctctttcggtgtctgattggcaggaagccaaactgagatacatggtcaaggtcagcctctctgagaaactgatgtttgagccgagatgcaaatcatgtgaagtaaccaagatgcagaggtctggaggggagggctttccagctaaaaagaggagcaagagctcaagccctaagacaggaaggagctgatgtgggctgggcccagaggcagctggtatggccggagcacaggaagcacaggggagcatgatgggagatgaagctggagaaataggcaattaaacttcattcaccctgatgatagtttcctttgctgtgcagaagctctttggtttaattagatctcacttgtcaatgtttgcctctgttgcaattgcttttcgcatcttcatcatgaaacctttgtcagtgcctatgtcctgaatggtattgcctagattttcttctagggtttttatagttttgggttttacatttaagtctttaatccatcttgagttgatttttgtgtatggtgtaaggaaggggtccagtttcagttttctgcatatggctagccagttctcccagcaccacttattaaatagggaatcctttccccattgcttgtttggtcaggtttatcaaagatcggatggttgtaggtatacaggtatctccctgcagaatgggagaaagttcttgcaatctatccatctgacaaaggtctaacatctagtatttataagatacttaaacaaatttatgagaaaaatgaacaaccccattaaaaagtgggcaaaggacatgaacagacacttcttaaaagaagacatacatgcagccaacaaacacaaaaaagctcaacatcactgatcattagagaaatgcaaatccaaactacaatgagatgccatctcacgccactcagaatggctattactgaaaagtcaaaaaacaaaagatgctggtgaggttgtggagaaaagaacacttttacaccgttggtaggagcataaattagttcaaccattgtgtggcaattcttcaaaaacctggaggcagaaataccatttgacccagcaaccccattactgggtgtataccccaaggaatataaatcattctattataaagatatgtgtatgcagcactattcacagtagcaaagcactattcacaatggcaaaggcatggaatcaacctaaatgcccatcaatggtagactggataaggaaaatgtggtacatatacaccatggaataatatgcagcaattaaaaggaatgagatcatgtcctttgcagggacatgaatggggctgtaagccattatcctcagcaaactaatgcaggaacagaaaaccaaataacgcatgttctcacgtataagtgggggcagaatgatgagaacacaaggacacatgggggaaacaacacacactgagccttgcaggagggtggaggtgggaggagggagagctgcaggaacaataactaatggatgctgggcttaatacctaggtgatgggatgatccatgcagcaaaccaccatggccacgtatgtaaggaagctgcatatcctgcacatgtatccctgaacttaaagtaacagttggggaaaaaaaaaaaaaaacttcattccagtttcaatgcaagcattggagggttctagacagggaagggactgcaaatgattctgtcttctatctgtagaagatcttctgggtgctttgttgagaatgggttgtgggatagtaagaatggaggctgaggaaccacttaagaggccagttcagctgaaacaagagtgtcaccgttgcccttaaatagtttcttcaggtttttcctctaatgccctcctggcctttgaggatgtaatgcagacaaagagaccagggaagtccagatccattttgtcccgttcaagcttcttttctccaacccatgtcatatcccagcaccctcccccttgcaaaacatgagctctcatacatgaaaatgaaggctgattcagatgcactagggagtggcagagataggagacgagagctgttgtcatcaacagccagatcacaatgccacattttgtgggcatgacactgtaaagcccatatggatatagagttcggatcccctctgagtaccccaaaagaatctatactggggccgagtgtggtggctcacacctgtaatcccagcactttgggaggccaaggcgggcagatcatgatgtcaggagatcaagaacatcctggccaacatggtgaaaccctgtctctaccaaaaatacaaaaattagctgggcgtggtggcgtatgcctataatcccagctacttgggaagctgaggcaagagaatctcttgaacccgggaagcggaggttgcagtgagccaagatcgtgccactgcactccagcctggtgacagagtgagacttcatctcaaaaaaaaaataaaaatctatactggattactagttattattatctagactttattgaatatttcatgggaaatatgaagactagacctcacatggcacaccttacatattcctgttttctccaagaccctgtcctaggataaaaaagatgaaaaggaggcatgtaccaggaaggagccagagcaagcagggccttgtatgtcatgctcaggggagcttttacgtattttggggattatgcaaaaaataagactcaaactacacatagcggagaatagagctacagtgaccaacgtcagactaaatattgactaagcatatttgcttcctgaggctgctataacaaatgaccatacacttagtggcttaaaacaacacaaatttatgatcttcctgtttggacgtcagaagtctaaactgggtcagcagggctggttctttctggaggatctaggggaggatctgtttcctgatcttttccagctctggaggccgcctgcatgccttggctcatggcccctgcctcaggtcactctgacctccgcctcagtcatcacatctcctcctctcactctgactcttctgcctcctaatttcacggacccatcagcccacgcgtagaatgcaagataatctctccatctcaagatcgttcacttcatcacatcagcaaagtcccttttggcatgcaaagtgatctgtttactggctctgggaattaggacataggcatctttggagtggagggacggggaattgttctaaagactgaaagcaaaagtttgtgccaagtttcataagaaatagttaaatcctgttttatggcctcagttggcattccagctctggagtggggatgaccctgtgcattgtgtccccactcccaggaaaccagggcatgctttactgggatcatcctccaaagtagcaaaaaaaacctgctgtggtggaaagaaacccttgggcatgggttctcatctctgcacagaagaggtgtgttgtgttgcgttgtgttgtgttgtgttgtgtttgttttgttttgtttgagacaaagtctcaccctgtcacccaggctggagtgcaatggcgcgatctcggctcactggaacctccaccttctagattcaaacgatcctgcctcagtctcccaagtagctgggattacaggtgtgcaccaccacacttggctaattttttgtatctttagtagagacaggatttcaccatgttggccagggtggtcttgaactcctgaactcatgatccgcccacctcagcctcccaaagtgctgggattacaggcgtgagccaccgcgctcggcccagaagaggtgtttggcctactcctctcagcagccctctcctccctggggccaggtttttcaggatgccagagtcctaatggcatccttccctctcttgcgccatttctagacatgtcaaaatttactctctctgtccccgacacttgactgatctctttgtgacaatgtggctgtcacttactgggcatttaatacatgaaaaaaataaaaactttattgagctcttactatttgtcagacactatacgaagaggttcatatagattatcacactgaatccttccagaaatcctattagataagtaatgttactgtccctcattttattaacaggaaaaggagaagaagacactgaggcacagaaaggttaggtaacttgcctaagatcactcagctgggaataggcagagtctttgttgaactctggtcttctgacctggaatttatgctcttacaaaattacccttctgtagtcccagatacatgggaagctgaggtaggaggctcacttgagcccaggagtttgaggccaccctgggcaacatagcaagaccctatctctaaaacaaaacaaaacaaaacaaaacaaaacagaaaagtaccctatattggaagaggtgaatggatggaaggcaggaaatgcactgactgttgttaaatagcattggcttaggtgctagaaagtctagatttcctatcctgcttcaccactccttgctggatgacttggactagtttcttcccctctctgggcctcagttttaacagatacaacatgaggggcttgcatagaaaggagcaggtttgctccgacactagctttctgtgtgtctaatgctggtagcctgttggttaccaccccaccttgctttgacctttaaatatgcccacaagacgtggcatttgctgtcacatggccacgtacggtcagcagcaccagggctaggttcctgaggccccctcacgtggcacggcctacagctcccctatccctggggcctccggcaaggatccaggcggcagccggcagcggcaagcatgtgctgtttctgtggtttctacttagaacagtttcctgtttcaacctgccagttccttaaaagcattagcttgaggttttgccgaatgactccgctctattttcataaaggggtggaggggctcctcctgggagccgagcccagagctgaaattccacatgaattaagggtatatcgagcttggaagttcatctcctgaaaatagtctggcttggggtgactttcagagaatagggagagttcctccaccagccagattcttgggcccaacttgtctaagaggctgcctccattcccttatctgggcctcagtttctccatatcttacatgagagggctggatcttctctccagattctaggcagtccccacgtctctgtttagtgtatatgaaagtaatgagcacagtagtagccaacacatgtatagcccttcctgcactgttctaagcactttataaatgttgatcctctgaagtgaacactcttcctgtccccattttatagatgggaaacagaagcaagtgatgttgactaatttgcccatgctcacgttaccttcaagtggtcaagtcaggagttgaaccctggtgatctggctccagagcccttgctgctggctctctcaaaataagacctttctggcggcagatggcttactattgagcagggcgcagtaggtgtgatctcagagggctcaggtttgagtcttggattcatcatctgcgtgaccttgggaaagtcactcaattctttggaacctccattttctcatcaatgaaatggagctagttgaacccatgttgttgatctgccatagtgtgtaggcaatttgaggtgaagattatttatgaagaagctcgggaccaagacaagcagtctcgtaacataggcttttattattattcccatatttcacatctcctactcccgccctcggttctggggttattagctagatctgcttttactagggagggactccagaaggaaggtccaactggaatgctgacagctccaaagccaccttcctagcctagagatagggtttgggggactggcagtgacttcttagcagccttgagtcagctgtccagagtggatggccctgtgagagccaacacttcctccccacccctgtgaggcatctgggtacgggtggagccccgtgggaaactggcctcggccaccaattccagacttctatccgcctgactccttggcactgtccgagtaagagacatctccaatttaatccacccaaacagaactcttgatttcccccttgaaatctactcttcccttggtcttctctatctcagtgaggggcatgacccaggttgctcaacctaaaaccctccattcaccttttttccttcacagcctgtatccgagccatgtgcaaattatgtggactctttgattcgatctccaaattttttcccgactctgctgtcttttctccaccttggtacaccatcaagggtcaagggagaggtgctggtagccaccatcgttgtttatttagtctacttaggcaaccccaactcaccaccctgtgggtacgttgtcccctgcctccccttgacacaaccaaaggcatctgcttgggaaaatacttcatcaactccctgcttaaaaccctctatggcttccaaatggacaaagactaagctctttacatggtctccagacccttcgagatgcattgaaccgtctggcctcatcttccaccgctcttcctctcgctcatttgctcctgccatgctggtctctctgcttcttaagcaagttaaacaagctccttcctaccacaggactgtgtagcaccagccacttccctgcctgcaaggctttaccctcagatgttcctggagccagcattttgtcatcagtcaggttccagttcaaatgtccccttctcagaaagccttccctgaccaccccatctaaagcattccctgctcccactcactcttctcaacacttctgttgttttctcagacgatttatcatctgacattgtcatgtttacttaattgttcagttgtttaccatctgcccccttcactagaatgataatgaaggctgagaaaagtgcatgttttcacagctatatttacactgtaccaccagtgggagctggggggaatctggcacataaaaagcactcaataaatagttgtaaaatgaattcaaaagtgtgctatgtcctggaacaagttaactctctgggcttcaatttgcccattgataaaataaaggagaatgaaatgggttgtatcaaaggattctctttgttctcacattttctggatctctggatccacaagttgcccttgggatggatggatggatggatggatggatgatttctgggggttttattgaagacacctgggacagaggagttatcaggagcaagatggaggcagggaaagggggcaaataactccagtcagaatgtgcttcttttaccccaagtgagagagaggcatgatcccctctttcctctgtgcccaccccatggaccacctttacccatggctgcaccaggggaggtggcagcagcagctgcctgcccaccaccgggagctccacccaggagataaaaggagccgaaggaatgtgctggcaaagctgacgtccctgtcttctcaagggtgtaaatgggtttcctgctcccacaggttcaaagagcacttcatttcacagcaaaagtacagctaatgagaaacagattgtctggctccagctgcagctctgagagcccaggaggcaaaggaaagcccccaagaacctggatgtgaacgtgtgtactaagggactgtttcctcccctttctctggggccacagagctatttcaacggcaggggaaggagttgcagagaggtgggggtagaggcaagagcaatgtccccactggcagttaagaggagcccttgggagagggcttctgagctctgggtcttccaatcatgctgagttctttttaggcctgggcgccaagtcaggcaatgcctaataataataacaacagtttccttgtactgagagctgccaaagtgccacctgtggggtgggaaggccacgggctttgaggccacaaggccgggtttatggactctggtcctcagtttcctccagccagttagcacagtggtggtgatcagtgagaatcccaacactgctattcactgggcagtgaaaataacactatttggaggtcctgaggacctaggttctagccttggttcagccaagtgtgattcggggcaaggcaggctgaggcaatgggccttggatagcaaaaaggacttaccttaaaattttgatacttctcacatgggcaagtcacttgggcatttctgagcatctgtttcctccaccgtaaccagcaccaataacatcaacctcatggcatgtaatgagggtcaaatgagaagagacacataaactgctagccctgggtaggtgtttgaggttggggttggagcccaaaggccttagacgcaacagagcaatctgtgaccaaaccagaagacaaacccaggttggactcacactcaaacaatacaataaaaggtaaccaatagtagagtgggtacaatatcccatgctctgtgctgtagatcttagtgtatcctcacaaaaagcacatggggccggtactaccattgcccttaaatagctgaaaccagggcttaaactgaaaagactagattccagagtgtgtgctaagttactaggctattcttcaaagtttgtagcttctcctctctgctctgggtatctacctgcttcctgggatccaattgtcagcagactcaaagtgcccaaattgggtagccagctgtccccttgtccccccttcccctccagggtgttagaaagactatttccctcattcaataaatatttcttttcttctctctctctctttttttgtttttttctgagacagtcttgctctgtcacccagtgcagtggctgcagtcatagctcactataacctcaaactcctaggctaaagccatcctcccacctcagcctcccgagtagctgggactacaggaacatgccaccacacctggctttgtttcttttttgtttttttggagagatggtgtctcactgtgttgctcagactggccttgaactcttggcctcaagtgatccttccaccttggcctcccaaagtgctgggattacaagtgtgagccaccatgcccagcctcagtaagtgttagagtgttcatttcttgaacatttactatatgctgggcatttggatgcaacggtgaacagaacagccacacacaaaacaatccctatcttcatggaacttatattctggtggagtggtggggaaaatgaacaaatggacaaatgagattttaaacaccaaatcacagtttcaccagtattcgtttatcaaaggttgtaagatacttatctgtgggctccaaaagagtttggttcttgcattcttccttataatatttaatactaactgtatgctaggaattatgccaggaactgagacgcaaaagatgaataacacatgtaccttaccgttggtgaagtcctattctaggagagaaatagacatattgagtaattttagtatgtggtgctaagaactgttttagaggatcccctcctccccaggacctcaaagaggggatgagggaagaaccaggaaaagcctgaggaaggcttcatagagaaggtgatgtctgagctggtccttggaagatgaggctgatctgtcgaccagataaaaatggaagtcaagacttcctggaataagaagtggacataaaagcaagaatatgcatagcatgtttgggaacagagagtagtcattcttatgtgggtaaagaataagttggatgtagaggagaaatgggacaggagagtataatattaaaaggaacgctgggtgccggtaggtaagtcatgtggagttgtgggagacctgtaagggtgtgatcagtcacacatgtattttatctttctgtcttcctgttcattgatcctgtcttcatttgtgtctaaagttatgttaaacctatctcttggacacttaaaatgagttatttcattattcagttctggaatttctggttgattttttttttttggtcagtttcacttctatgtggaaattttccatctttttcatttatttccttgaacatataaatcaattgttacagtctatggctaagaatgccaatatatggattgccttttctacattttcttttttcttttttttttttttcagtccttgaaaaaaggactatgagacagtacttgtctcatagcatgcttggctgcttccaggtcaggggcacacctcgggtcctaccagtgaccaccccttgctcaaagaagcagtttggagtctttcccttggcagagcattgaggtcagagaagtgttcctttaaagcacacagtggacatagcagagatcatggtggacttggtggagcagaatctggggtgattctgatggagagggcaaggcagcagggagggccctagaaggggatgtgggagaatatgggaagcaaggccgtaagctccccagcctgggcccctccatagtaactgcctactcgccagactgggagtagcacagcaccaatcaatctccaccccaccctgctccagctgggaaagacatcctggctgtgtaaactaaccttatgagtcttattccaagaaggccaaggaattcgacaggaaacaacacaagctagtcgccttaaatctctgtctgggcttgacgtgattggatctgaaatagctacagagagcctcattcttaaacctgttgaacccacatggatacatgcatgcttgcgtgcacaaacagaaaggtttaagatgaggccgccacggggtgaggccataccaggcctccatgcagaaactgagaccaaagctcccatttcaagtcagatccgcagtggaaggcgtttgacaggccttgtcagtcagactccagcagtctgactccacagccaagaatccttcacctctctccacactcttcagcttgaccactcttgagagctggattcagctcagcaatggctgttctcaagtgcagagtgagccatctctgccaagagcttgtcttgccagccgcttcctggccccagccctcagcttgcccaagtctgacatcacccataacccccaccaccacccccagaataaagagccacctcagaggctgagactgccagacctggtcccccactccttcctggacatgtctggctgacaactcagagaagcagcatccattccagccacatgcacagccctcactgctcagggtgacctgactaccccagatcaccatggctggggcctcattcacccgatatgggagagattggtgatgtcagatattgggccccaaacactgagggcttccagccttcatctacccaggagactcaagggaccttacaggggtctttcttcttactgaatcttaggtgagttcagacttccctgaagcaggcaggagtatagcatcgtgggctcaggggtcagatctagctgagctctcaatctggtctgctacttgctagctctgtggactcaagcaagctgcttaacctcagtttcttcatgtgtaaagggcagatagttaccttgcagggttataacaggactaaatgagttgatatatgtaagtttcttagaagactgcctaggacccaaggagtggtcaaaagtaataataggagaggtgaatggggagttagtatttactgggtacagagtttcagtttgtggagatgaaacagttttggagatggatggtggtaatggttgtacagcaatctgagtgtcctgtatttcatgctactgaatggtacacttaaaaatacttaaaatggtaaattttgttatgtatgttaccacactttaaaaaaaaggtcagagagggcgtgttggctcacacctgtaatcccagccctttgaaaggccgagatgggtggattacttgagctcaggaattcgagaccagcctgggcaacatggcaaaaccctgtctccacaaaaaattagccgggtatggtgtcgtgcacctgtagttccagccactccagaggctaagatgggaggatgacttgaacttgggaggcagaggttgcaatgagccgagatcatgccactgcacttcagcttgggtgacagagtgagaatctgtctcaaaaaaacaaacaaaaataacagctatgttattatttgatggggccaccttcagctccacatggggccctagggtaaacatcaaaacttgccagctggacagaggaatggcctcctccttcattatggagtttaggctccatggtgagctccagaagcttctcctacccaagaacattaaactgaagttctcagtggttctacccacatacctagttgcctggggagccctctgaatgacacacaggcacacatacacagagatatgtgcccagtttcagaaagacacacacagacacatgtccaagtagacagacaggaagggatgaggtactcaagtgggaactttactctttggagatgggtacaccaactgcttcagggaaaacgctgaaggaaatcagatggggttggggcaggatcaccaaacacagcctcattgtcccatccacatctttgtgtgggctctacccatttgcagcatcctttctctcctttgatcttcttcaaaacctcccaagccctccagtgctctaaggctcagctgacagccacctcctccagagggctctccaggattccctagctctttctgggctcattctctgcactgacaatcaaagcctccgtggagtacttggttccagcacagctgttgttcaccaatcactttgtgtgtgctgtctcatgtctcctctgtacttctttccttgcacactgctcctaattgtgcagactatgctttcactttttttttttttttttttttttgagacagagtcttgctctgtcacccaggcaggagtgcagtggcacgatcttggctcactgcaacctctgcctcccgagttcaagcaattctctgcctcagcctcccgagtaactgggattacaggcgcccgccaccatgcttggctaatattttgtatttttagtagagacggggtttcaccatcttggccaggctagtcttgaattcctgaccttgtgatccacccacctcggcctcccaaagtgctgggattacaggcgtgagccaccgcgcccagccatctttcactttttaaaaatggtagcatgctgatgaatttttagaaacgaacaaatatttacgttatttcacatcagcaattcccaaagtgtgtttcaggaaacaccagtgccataggatgtcaagaggtattaggagacaaaagggttccatacatttgggaaacactgagctaaataaacagctgtatttattacaggacataccagagactagaaaatgccaacaattactttagtagtgtgctggaaccagctcttatagttcagtgacacaaatttggtaatttggacttggccagggtgatagtatttattccatgaaaataagcaaacgctacatatctgaggctttgtttttgtttttttcagagagctggcttaccagcacattactgaataccacttcaagaagagactgtggcatgtaggttttcctaatgtatttcatcataaaattcctttattatcttgtgggaagcatcttgggggaaggagcgctccgcagaacatacttcggggaaagttgttccatgcaaagatacccaaactaaataccatgggagatgagcgggaagaacttacattcattgagcatctactatatgctaagtatgatgttggatgctttatatacctggcctcatgtaattcccacagaaacactagaagaggtacaaatagtgcccatattttgtaaatgaggaaacaaaagatcaaagaatttttccaatttcatacagccaggaagtagcagcacaaagcctatcttaatcagagattataatgtctagtggggtggcattcgcaacaagatttaggtaatcattttagaagagtttgttaaatagctcatatgcaggtcatgagctatacttagaatctagttatctagagttgccagagacacttcaagaaaaaaaaaaaagaaaagttactgaaagtctcagctggtccacagtcttcagtcttgtcatctgctatgggctggcattccagaatatgccagacttctgaatctcttgggcattttttaaaaatgctggtggcttggctctacccactccccaaggcaattctaacctgcagccagggttgagaaccactgaaattgttatgaaagggtccttagagaccagccagacaaactcccattttacagatagggaaactgaggtccacagagtggaagtgacctgaccacagtcacataactgtcagttgctggataagactagagtctgggtctcttggctcctgtacaatgccctttccacttagcatgaggggccttcagatctcactgcctaaacagatatgatttcagctgaaatccaaacccattttggacaactgaggcttggccacttttccatggaaaagctaaccttatcagctaaaggcattcaggaaaagatgctcccccttgcaaggagaccattgtcctgagctgtgtacagaatcaagccacatagttccttctgtgttcctcaagctcatctggaaagaatcctccctccttcgtagtcacacataactgggttactgggaaggtcactccaaggggatttgtacagtagcattttattttctttggcatggtttcctttggtgttgatgcagatttggtgctccctgggatatctgttttctttttttttttttttttgagacggggtcttgctctgtcacctaggctggagtgcactggcacaatctcggctcactgcaagcgttgcctcccgggttcacgccattctcctgcctcagcctcccgagtagctgggactacaggcgcccaccaccatgcccagctaatttttttgtatttttagtagagacggggtttcaccgtgttagccaggatggtctcgatctcctgaccttgtgatccgcccgcctcggcctcccaaagtgctgggattacaggcgtgagccaccgcgcccagccgggatatctgttttctaggacatattgtcaagtctgaatggaggcacaggccaccaaggcaaggatagttaaaatgacccaaagacagaacccacatgatcttcagcaatatgctggagcccactgaaggcttgcatgagaagcaaagcaagcctctgaaagtgtacctgaccacggaggaactaggggcagaaaatttaaaatgtaggtgaagcttaaagcccataaaacagtttctacaaagcctacagtgtttattcttaagcctataactttctggtgtacccctgaggatgactgaatgcagacattttctggcaactgaattaatttaatatacagaatgatcaaccatgagtcagttaaatgttagaggtggcctattacagtggctggctttgattttagaatagctcattcattcatccatccattcaataaataatgaccaagcatctgtcctgggtttgacgatacagtgatagaccaaaaaagggaaaaaaaatacagtgtctccactcatgacacttaaaattcatggggaagagaatggggagaggcacataatctaaaagcaaatgaataaggaactatcacagcatgtgcaatgaaggaagtgagcaagtggaagtgatagaggccaagcccagtggaagaagctttggtatgaaggtcacagaaagtttctctggactgcagataaaacagggattcgcacattccaggcagagggaatagtgcatgcaaaggctcagagacagacagagcttcttgactcaaggatctcaaagaatgccagtgggtctgaagctgagtgagaaaggggcaaaggggaggagagggcactgagcagatgaacagaggtcaagccctgccagccctggtatttcaattgcagtggagagccactgaaagtttcaagcagaaatgccacaacagagtttctgggaaatacatcagaaccccaaatcacatggtcttgtgagctatccccgctcgggctgattatgacaagaggccaagccacttttgctgcagcaaattttctttgtctgtcattaattaattagctcagtcaagcagtcagtagcagctcacctgcaaggcactgtcctacacactggggatacagtgagcaggacaccctagacacgtcccatgaagcttgtatctggtgggggaggcaaacaatgaaaatgaatcatatgctttgaaatagtgataagttccatacagaaaataaaacagcaatattaggaagagtgcatgaagcagaagccacattagttgagacagtcagggtagccttctcaaaggagctaatatttgagctgaaacccaaatgataaggagcctgtggccatgagaaaactaaagagcacaagtggcaggggaaagaccaaggacaaaggcagcctcaattgaggagtcaaggtgaaattcttcctgctcggcagcagagatgggtttaatcttcgtgaggttgttagcctgggattaaaaagccagaaagaccaagatgtagggctgtggcccataggaccaccctcaggtcaccaggccagagtcagtgctggaaagctgaggcaggttgtcaaactgaggttaagaaaagagggcatcagacacctgatcaaaccatccagcgagtcttgccctgtacctcgttctccacctgcccctggcccacagaccaactcctggaagcaagcatttccgagaagatgtttgaacttggtattattcaagaaatgcaaattctaacaaaattaggtaagaagtccattttggccaatcagattggttggcaagggtgaaagtgatggatgatacccaggagtgttgaatagacctcttggcttgcaaggaattgagatttcttccagtggtagcaagttgataagaaggaagaggcataggcagttattttgagtacaggtgcacaggaatctggagaaggacagcaagagagccttgggatggacaggaacattgaagaatctttcttctccataaacacaacacaattactctgcttgcccctctctctgtctcttgcttagaaacagctcctcttctttaccctcagcttcttctcccccatcactttggctggtgtttaaactttattggtcaccctttagttaatgacctttcagacctatttctcactgctaactgatgaattattttcttgttcccaaaacaaattcccaagagaatgaatccaattggttcagatcgtctccccatgccaagtcattagacatcctagggccaggtatccactcctggttcgatcagttgaggcaaaactcagcactggagcatgtgcactcaaaaaatcctggccacccagctgttatgggctgtgtagggtgaccaacccattccagtttgcccaggagtttcctggtttgaaaactgaaattcccatgtccaaagacccacctcagtcttgggcaaacagggacaattagtcactctacagctgtgggtaggacagctccctttggagatgtggaaggagaagaagagtgaagagcatctccggcatgtcactgttaggcagggtatagagaaagggcgatgttcatctgctgatggtgggagtgaaaattgttatgatctttcatggggggcgtgtattagttcattcttgcattgctataaagaaatacctgaaatggagtaatttataaagaaaagaggtttaattggctcatggttctgcaggcagtacaggaagcatgatgctggcatctgcttggtttctcggaaggcctcaggaaacttaaaatcatggcagaaggcaaagtggaagccagatgtctcacatggccagagcagaaggaagagagaggaggaagtgctacactttctttctttttctttctttcttttttttttttttttgagacagagtctcgctctgtcagccaggctggagtgcagtggcacaatctcaactcactgtaacctctgcctcccaggctcaagcagttctcccgcctcagcctcccaagtagctgggattacaggcatgtgccaccacgcctggctactttttttgtatttttagtagagtcagggtttcaccatgttggccaggctggtctcgaactcctgacctcaggtgatccaccctccttggcctcccaaactgctggaattacaggcatgagccaccgcacccagcccacacttttaaacaaccaggtcccataagaactcactatcttgacaacagctccaaggtggatggtgttaaaccatgaggaaccacctccatgatccaatcacctcccaccaggccccacctagacactggggattacatttcacatgagatttgggcagggacacagatccaaaccatatcagggcatatctggaaatatgtatgaaaagtaaatacacacacacacacacacacatacacacacacatgtgtgtgtgtgtgtgtgtgtgtgcatatatatatatacatattctttgacttagaaacacttttttggggtaatgtatccaaaataatcagtccaggttatgaagatttatatgcaaagccattcactgaaacattatttgtaaaagtaaaataatggaagtaacctaaataactacctgtacagtaatccgattagtgaaataaaccagcatatgtccaatggaatactttttcaacattaagaataataacttggctttctagatattgatagggaacttctccatgagacagtcttaatgaactaaagcagaagataagatagcctttatagaacaatcccatttatgtaaaaaggaaagaaaaagatgcattgaaaagagttgtgggggaaaaaaaaagaaaaaggaaaaagctttggaaatatcccactggtgggattggaggtgatattccttttttaaactgtttgggtttttctgaatgttttgtactgagattattactttcacatttggaattttttctatcttttaaaggggcgtaaaaaaaaccctggttcaacaaacctgatgaaatggtgttttcactcaaaaaagtttctattttccaattttgttctggtttgttaattttaggacacgcagaggtttgatgcaagttccaactgatccacttgggtttggttttgtttaaaaacaaaaacaactttgatttcatctgtattacgtttatagaaaattaatattgggatttggtgctggattcagccatttgagccattggttcctattcttggtttgatgccgttcaagttgttcctcagaattcccacaacaaccctgaatcattggaatgaaggcagagagagattttggagcctgaattatctagaaaattgttgtctgtctcatcctggaagggcctgcaagaggtcattttcccccgggcacagaacaaagccacagctgggacatttccagaaggcctgttggccccaaccacagtgtggccagagccacgctgccctgggacctcagctcctctgtgctcttagcctctgcttgctgctgcaagacaggagctggccccacttcccatcactgccccgcagggctcgagtgattctctcttccatgccaggcccgtgcacagcccccaaagcagctccatctgggctgtgcagcctgcggcaaaagtccttccgcacggagtcatcatgcatcccacgccaggaaatggctggctcaagggccccgtgaggggtaactgagctgctcaccaacagcacatgcatcttgctcctttttaaaggtttttaaggtgtgctctctggctgtgtcgaggcctgggtgccttcctcttggaagaaggtgtgaaggtgaggagagggaggcaagagtgataaagaccagaggggaccccagagttcctgcctcaggcaagctgcttctgtgaaatgaatggggcagccctctctccccaaaccaccgggtagggtccccaaagggctcattgaagaccctggcccttgaggcttttctggagaccatctaagcctcagcagggagagacgatggttttaaaactgtgtcttccttggaaaaatgtcttcaactgcacctcagtttcctttttttaaaccagcagagaagtacacctcctgcacggggttgtcagagccttagagaaagttctgaaactgcctactacatcgtggtgggaatgggccgcctggagtgcaggcaagaaggggctgcattgtctgcagataatttaaaaaccattataaagcttactaaaatctgagctgctttgtattatccccacgcaccaccgtttctaaacaatgccagtaataaatactcttcatcatccgtgtagactgccgtgacagcccccaacgtggccacaccactgcctgctgcagatcacacactccattagtcacagtgctttttttattactaaacagtattagcaattatatgtaattggctcttattcatatgcactaataatccaactgtcagatgtgaatgctaagctgtaatgtcatagatggggagatcctgagcagatcatctaagggctctaagtcttagtttctgatctatgctgcagagcactggcagattacaaagtgttttcccaaaaattccctctgaattcttacactggccctatgaagtggcacagtgatgcccattttgcagttgaggagacagaggcttaggcaggtgaagtgaacagcccaggagcccttatggaaaggagacagagtgcctccaagccccttccccatgggtctgttgtggcaccagggcttaaggcattgtctagaagactatcaggaggcagcaggccaaaccattaccacctggaggtaattgacacagataggaaaagggaaaaaatctccatttcatgccagttactcccacttattatctcatttgggcctcccagatgcctcaagaggtggattattcccagttcacaggaaagggaatcaagtcccaggaagataaagtttacttacctggaggtacacaggcaaataagaggcagagctgaaagtaaaccctggtccatttgagactgacactctgcacctaatgtgttttcacagtggccctgagtatccaagcaaagagcatttgggaaaagaaaggctgaggcccatgcttctcagaatcacaagtgactacaagttgaggtctaggagtgaaagagatgactgacgtttcctccatatggcctggggtttttctgacttacactaacatgagtcccttattatttgtgtggcaagtgcccttggctccagaggaggctaggaaacatgtccacatccgctcatgtatcctctaagcttgcatcatttgtgatagtctgggactgagagtctttatgcgttctctcattcattcattacccatcatgggtttttatcaatatcatcattattttatcattaatatgattgaagcaatgtatgcacatgagaaaaattcaacagatactgaagggaggacagcaaacagtaaaagtcatagaaggacatcatcttaaagggtgagcaagcatttaaatgtgagtatgctgacacaggagacaataggaggaagatggtctcttggggaggggaggtgggcaggcagagagaaatgtcctgccctctagggaattccaggggccagggaagaaggtgaagagagagtagggttggggtgagcaatttgggaacagagagaaggagaaggagcagccctgggacaacattcaggactctacaggaaaagaggcaaaagaaaacagtggggtacatatgaaagagactggtcagggagcaaagggtgcctcagcaccaaaaggctctaaatcagtcagatcaaagtcagtgtgctgcaaattaattctttctgagtctcccttctcaggtcccccatctgcccctcagctgccccgtctctttgccatggtctccctttttctacaccttggtctccccacttctgcctgaagaattcctgttaacattgcttttagggcaaatctactggtagtgaattatctcggcttttatagatgtgtaaaagtcttcattttttcttaattgttcaaatatatttttgttgcgtgcagaattctaattttagcattttctgcatcaacactttaaatacgccatcccattatcttctggcctgcatagtttctgatgagaagtctgctgtcattcttgtttttgtttctctgtacttatggtgtcgcttttttctggctgctttgaaaaattcctctttgtttcactgttttctgcaattcaattaaaagttcctcagtatgtaggtattgaaggaacatacctcaaaataataagagccatctatgacaaatccacagccaacatcattctgaatgggcaaaagctggaaacgttccccttgaaaaccggcaaaagacaaggttgtcctctctcaccactccaatttaacatagtattggaagtcttggccaagagagtcaggcaagagaaagaaataaagcacatccaaataggaagaaaggaagtcaagctatccctgtttgccattgatgtgattctatacctagaaaatccccatggtctcagcccaaaagctctttaagctgataaacaacttcagcaaagtttcagcatagaaaacaaatcaatgtacaaaaatcactagcattcttatatacctacaacagccaagctgagagccaaatcaggaacacagtcccattcacaattgccacaaagtgaataaaatacctaggaatacagctaaccagggaggtgacagatctctacaatgagaactacaagacactgctcaaagagatcagagatgacacaaacaaatagaaaaatattccatgctcatggattggaagaatcaatattgttgaagtggccatactgcccaaagcaatttacagattcaatgctatttttatcaaaccaccaatgacattcttcacagaactagaaaaaactattttaaaatttacatggaaccataaaagagcctgaatagccaaggcaatcctaagcgaaaagaacaaagcaggaggcatcacactacctgacttcaaactatactacaaggctacagtagccaaaacagcatggtactggtacaaaaataggcatgtggacgaatgtaatcaaatagagagacaagaaataaagtcatgcacctataaccatctgatctttgataaagtcaacaaaaacaagcaatggggaaaggactccctattcaataaatggtgctgggataactggctaaccatatgtagaagattgaaactggaccccttccttacaccatatacaaaaactaactcaagatggataaaagacttaaaatgtaaaacccaaaactataaaaatcctggaagacaatggaggcaataccattctggacataggaactggcaaaaatttcatgatgaagacaccaaaagcagttgcaacaaaagcaaaaattgacaaatgagatctaattcaacgtaagagcttctgcacagcaaaagaaaccatcagcctagtaaacagaaaacctccagagtgggagaaaatatttgcaaactatgcacctgacaaaggtctaatgtccagcatctataaggaacttaaatgtgcaagaaaaacagacaacccattaaaaagtgggcaaaggacatgagcagatacttttcaaaagaagacatacatacagccaacaaacatgtaaaaaaagctcaacatcactgatcattagagacatgcaaatcaggactacagtgagataccatctgacatcagtcagaatggcttttattaaaaagtcaaaaagtaacagatgctggtgaggttgtgcaggacacttatacactgttggtgggtgtataaattagttcaaccactgtggaaagcagtgtgatgattcctcaaagagctaaaaccagaactattatttgaccccacaatcccattattgggtatatacccaaatgaatataaattgttctaccataaagacacgtgcatgcatatgttcattgcagcactattcataatagcaaagatatgatggaatcaacctaaatgcccatcagtggtagactggataaagaaaatgtacatatacaccatggaatactatgtaaccataaaataaaatgagatcatgtcctttgcaggaacatggatggagctggaggccattatctttagcaaactaatgcaggaacagaaaaccaaatactacatgttctgacttataagtgggagctaaaggatgtgaacacatgaacacaaagggggacaacagacactggagcctgtttgagccaggagagtgagaggagggaaaaaaaatcagaaggaataaacataaggtactaggcttagtactggggtgacaaaataatctgtacataaacccctgtgacacgagtatacctatataacaaacctgcatatgtacccctgaacctaaaagtcttttaaaattatcttaaaagaaaaaaagttacaatataatttcagtttcaaggataagttctaataatacaaaaattaccatttctaccctgaaataatacaataaaatttaaatatttattttaggtacataagttgtatgctttttacattagttaagtgtaattatgtacctccaaccaaaaatatttcaatgatttttatcaaaaatgcatttgaaataaatagactatgagttttcctaataaagccaatctcctgatgagtagattgattttagaaaattttgtttagatgaaattacattgggtgggatgcatttaaggacattatgaaaagcacctcaagacttttgccatcagttttcttctctttttcccctttggatgagacttagaacataggcaaaactctctctctcttttttttttttttttaagcgatggagtctccctctgtcacccaggctggagtgcagtagcatgatcttggctcactgcaagctccgcctcccgggttcatgccattcttctgcctcagcctcccgagtagctgagactacaggcatccgctaccacgccaagctaatttttgtattcttagtagagacggggtttcaccgtgttggccaggatggtctcagtctcctgacctcatgatccgccagccttggcctctaaaagtgctgggattacaggcatgagccaccgcgcccggccaggcaaaactctttatttaactccattgggtcagaaatgtacagatcctgagtgtgtataataccagatttaattttcccagtgaattgtcactgttagaccatttaactgctctaatttatttattaattttgaacccaaagcaaagtctacctcttaaggaaaataaaagagcaaagagtaaattctgtataaatcacatgtattaaatagtctagtgataactttttcaagaaaataaaaattgcaataattttatctaccctgatttaaggagacccaagaagtgattttaaaaaatatctggcagcataaaatgcctctaactaaccccagcatctagacactcactaatatttgatttctaattacttgtgtagtttgtcagtctttagcacaacgaaatccaattgaccagaacattttggttagattgcacttagctatgactaaatttttactgttattattctagtttctttgtgaatgtctcaactttactgcatcattaaactttaaattcgattttgataataagaatattttataaaatttttcaaacaactgcaatattcacacaggaactatggtactcttaaaaccactgtcatttttttttctaattttaattcatacccagttctttcaggattgctaaagacaatggcactttgattttaattaagtacttcatttgaaagccatgactaataaatgtcaaatgctaaaggttaacatatgttaagtggatatcagaagatcttttgtaacacgaaaagaattcaggtctgagggctcttagtttcagaatcactgataaatagtgcagacaagataggtgaaaaataactaccttaatttagatgcttctatttatttatttatttgagacggagtctcactctgtggcccaggctggagtgcgatctcggctcactgcaagctccgcctcccgggttcacaccattctcctgcctcagcctcccgagtagctgggactacaggcacccgccaccacgcccggctaatttttttgtatttttagtaaaaacaggtttttaccatgttaggcaggatggtctcgatctcctgacctcgtgatccacccgcctcagcctcccaaagtgctgggattacaggcatgagccatagcgcctggccgatgcttctattactttatttttatcttgggaatcaatgagctcaacaatggattagacattcctgtcactaagtctctacgcttcagaagataatacgtaaataattagatttgttgtttactgtctacattgtccatatctattatgtgttaccaaaatattgaaaataaatacatgaatttattcctgaaagaaaatcaagaaaatacttaaatcacacacacaaaaataagttcctcagtatggttttctttgtgttttttcttcttatttcaggttcattgagcttcttgggtttaaaatttccattgtttggaaacatttttttcattaatattttcataattttttctgtactcccctctcttcttctgggattccaataacacataatgtcagactgtttgctattgttccacagctcactgcggcactgtttgttttgttttgtttttctgtgctttatattgggtagattctattgctacagcttcaacttcagttgtcttctatagtatataatttgcatttaatttcacttaaatgtatttttcatttcagatattatatgttttatctctataaattctatgagcatccttttacatctttaacctctttcttcatcagcttcatgtttttctttatatccttggacatatttgtaagacttaatagcagctttttaatggtccttgtctacaaattcaaccttcttataatttcttgatctgattctgttgattcatttttctcctggttatgggttatatttttctgctttcttacatacctggtaattttttactggatgctgggtattgtgatttttatgttcttaggtggtggattttgttgtgtgtatttcaagaatactagattttgttctgatgagcagttaagtaattgcatcagtgggagggcagtttctgtaacagctaattattcatggatggaatcacaagtcctcattgaagctttttaagcaagagtgtgactcaatcaactgtgtgtgtttctttaaaaatcagtcttattattactctgcagagaacagattagaaacaacagtggattctagaaggctaattctgagtctgttgagaaaagtgatcatgttgacttgctttcagggaagcagcagttaagatggggcatatttaaaatatgtttagaatttataggacttagggattgattgaatgaatatgaggagttaacgagggagaagtagttatcgaggatgattcccatttctggaatgagcaactgagtaaatgatggtgtcacttattctaacagaacagtggaaatttggggtgaaaaaccatgagatctgttttgaagatgcgttacctatgagacatccaagtggttgatgttaggcaggctgctggtctgaagttcaatacagaaatctgggctgaggctgcttcctattacatggtgtttaaagctatttttcatttacagcctagaagcactggccatatgagtgcttgtctaatcccctagaattgtgaggtcttagagggctggcttgatgtgttttcctcttgtgttggctgatgcattggttggcacgtgaccggtgcttagtgagtgtttatgaaagggacaatagctgttggggactccttttttcatgtttctgagtttccccttgcctcctggttgtctaaaatgttgccttaaatttcattgttcttgtttgtttttctagtccaggcagacttttcaaattagcatgttagtcatttgtggagggtcatgaccctcccttgtttacaatagggccgtattatgtcagctcagagatcctatcctggagctggagttgggaccagataatgcaggagccacatcccttccagggaggctgctgtccaaggcttgggctacttgggcaaaatctctcagattcccaagggatactttaagcctgtggaatttcacagacttcacatgagcttaagactcttatagtctccatagtcaatccctgagttaacctgaaagttgcccaaaggagggaggagtcaagcctattttaaaaagaggaagcatctgaaagccttggaattcagagaccgtatacaaaatttcaggcagaaattttcgattgttggaacaagctttgttctaggagcagagaacctgagttccgggcctgagattcattgtataatattgagagaacaacttcccttctctggtcccattatcccccatctaaaactaagaagattggattcgatgacctcaaagtgctcttctatttattacattcagaggaattctatgtcctgggcggtatgagtcatagaccttgcctcaaggtgcttaaaattctagaactgagatgagaggtagactctgatattcccattaagacagacaccctgtttcctacaaatgcacttgtatacaaatctctctagaggagaggccctgtagatgaaaaacagaatcttactttggacttcacaagtaaaacagcttttagaattttacagctttatccagaaatgaatcttgtatcttttttgtctatcctcatcttttgaaggtaaacaaattgggccccgagagcaatgtgacttggtcaaggtcacacagtgagtccatggtagagcctaactcagcacctacccccatccctgcacacacaccaccctaaatctcatcaaaactgtttctccaccactctctcccttttggcaccacctcctgtctctgcaagctctgctgtctctgcagtggaacattcctgcacagaggggattaaaagagcaggggtggaatgctaagcctccctgcccattggcaagagcatttctcctgaactgagcccagcagggttcaggggagcccaacggcccatgtggaggtctgggttgtcagaaccaacttcagcctacatgccaggggctgtccacaccctgccctccatcacgtaaagccccccaaaacaagtactccatggtgggggcactgtggagtttgggtgttgtcctggagtctttctgggccaactctgtcaatgtgctccgccaagctcaatggagccactggagaccctgggccaagctctgtgggaagcccggccaagtttcagagcgtctagcgccaaggctgaatgtctggttcagtggagagtaagtccagatgtttgtctccggtcaatctcttattggctttctaactttggacacggatgacctactggggcctcacaaccttgggtagataaaatgaagatgatgtgtcacccccccatcctggaacacattatctaccctcctccatctcatgccactgagtacttgcagaaattaatgtcccatatcttcttcaagtacagagaagataaatagtatttacttcctacagttagctctcagttaatcaccaaagagtgatattaagggtatatagatgctctaaaattctttcaataacaatgtgtatttccaattgcatttactaactacctaaaatgattctggagctttgctaggtactaaggataacagaactaataatccaccatcattgccctttacagactttctaatgatgaagaaaaacaaacaagagttattatttataaaacactagcttttaaggaggtaggtccttcaaacaacaacaacagcaaaaaaaacactttgccacatttttgggtttggaatgtggggcttccacatctggggcaaggatgaattgttctgtgaaagaaacggtaagagattttatgggagatgaacaggtagagaatagagtggatataagttggcagaactttgtacacaattctgataaggtaagagtgatagagaagctctggttagcatctcagccaaagaaacgggggagaaaaaccatgatcaatagagattcatgcagatatgtgatgtcaaaccccttcagaccccaccttgaagttgtcagtagaatctactgtgtgaattttttctgaggaatgtgaagaggtgcagagttctatatacttcagaacttgaagccaaggcagggtgtatcagttatctattgccacaataatagtgtttaaccaacaacccccaaacctctacatacaacaaacaataagtgtttattgctcatgaatctggggtcagctagggttgactcttctgatcttgcctggtcttgttcacgtagctgggggccacctagatgtcaactaacttagaatggcccgggggactgggcatctcagctctgctccgtgcatctctcttgctccagcaggctagctcaggcatgctctcatgctgatggcagagtatcaaagttcaagcagaaatgtgtgagtgcttgttcaagtctgtatttgcttcaaatcccactggccagagtcagtcaagtgaccagactcggaatcaagaactagaaaaatatacgttgcctgtgaatgtgaatgcacagtgactgatagcattccaggtggtggctgttctatcagcctcaggatgacttgaagcagagtccccagctgaccctcagtgaacatattgcatcatcaagaatagactttctttgttttaagacatgggatttggggaatttggtacttttgtaaacctagccaacctagcctatcattactgatacaaccatcttatatggattgcttatcaacgtgccaggcattacattatgtacatttggcatttattcattcaaaaaatatggaatgcctcttacatgcctagaattgaactcagttcatcctcataacaacccaacaggatagatataattatctcagtgttatgaatgaagaaactgaagctcaaattgcttacataatgtgtccaaagtcatacagccagtaaatggcagagcaggatttaaacacaagtctgttggattccagtgatcatgctctgagctccttcattctactccatttctgttgatgtttcctcctgaggactctctattttagaaaagtaacttgccactgtaggtggattttaatagagtggcccacttagatcagggcatttaaagcaggagagggtctcctcttgggcaggctccttcatacatgttcgatccacatcctagtcccacttaatgtccatgacttttaacaccagctggagtgatagggcagctggctaccttaccagtgagttatggttctgtggacagagagagatttttctttccccagtgtctttccccaagctgcaaggaggacattgttaaacggttgggcagcaggaagcaggctgcaccacaggcaaagctagaatgaaatttcattctggggagaggtaaatcaatgctggagacaggagacacaagccttgagccaaaccatgataagaaggggaaacagagaaaaaagaatggagccatcctgacaattcctcctttctcctacagagaggagagagaggggataggaagagtaagttgagaataaggaaggtgggaagagccgttttcacccactcaggacaggaatgcattcattttttcatccaagaaacatttattaagcatctgctctgtgtcagccatcatgctgggtgctggaaaatagaaaacaagttaagtcatggtccccatttagaggagatcacagatgggtggaaaagacatacttgtaaacaagttaaaagatgtttactgtactcccttctctgaaacccactgaaagcaacaaaaagaatgaaaatataacagaaaattccatcttcaatacaactagaaaatggctatgggctaagatgattaactgctcaccacagttcattcctgtctttccataatagagaggagtgggtaaggaacaattgcccaggcagggaccacatttctcagccactcctttgcatttagttgagccatgtgatgagttctcaaagctggaatgtgaacagatgtgatctatgtcacttctgggccagcatggtcaagagatgggaacaccttctctactctctctctttgcccttcccctagtagaattcagggtactccaagacccctcaaaagagaaggagcccagtcctctgactcaccatatggcatctacctgctgaccaggaacatcagcactggacccttacactagtgagaaatgaatatataacatgttaaaccattgcaatttggaggtgtgttcagttgttacagaagctaatattactctaaagaaaacaggctaaaacccatatctgccacattcagtgaagtttgggtttcatcagaggaagacaaaaagaggagtcctatatgttaccagattttcttgaaagtaagataaaagatccctaaaggctgaataaataatcatttattggagaaaaaaaaaggaaaagagaggtaggtgagtcatagaagagtaaagttccctgtagtgactcatttctataaggcaaagggcaagggagacagggctgtggataggaaggcactatgtggatagccagtagtacaaaccctgacctccattgcttaaatgtcttagaggtgaggtggaagagaaagggagcagcagtcagccttgcagcttgtcagcagaagagatgcataaacattaaatggccagtcagaggacccatgaatctgtggggctttctggtgacccacactgacctcatactcatgggaatgcttcaaaacctgggggaaatgtgtccccagggaagagcatatctgataaattctgagacaccaaactcaaatggaatctgctggtagccccagcttgactccatccctgagaaaataacagaacacaacaagacgtttccaaagtaaaactacaaacaagcagacaagatctaacatgggatgaaaaaatgaaaatgataatgaaagccattacagaggagaaaattagcatcagcagaatgtgggatttattcagttgataatagagtcagtaacatagtaagagttttttaatgaaagaaaaggagaaataataaaaacaatgaaataaaataatgaaaaatacttaggaaatatgaatatgcatgctggacattcctaaagaaaggaacagagcaataagacagaaacatattcaaagatattataaaagaaaacttttctgaactaaagaaatgcctctacagaattaaaagtggtcttaatataccatagaactttgacggagaatgttcagtcaaaattctgaaggaaaaataaagctggcctccaacttctctttatcctttagtgccaaaaggaacaggtacaaaattctgaagctattgtaacaaacacatttcaaatttaaaagccagtctggttgactttcatgtataaagtagctgaaagacattcaccagcacagactcagagaaaatagcgcatggaactcataagttcaatagaggaggtggacaacttgataatgaaatctagtccccccaaaaatatatagtcatttctcagtatccatagaggattggttctaggatccccacacataccaaaatccatgcatactttagcacctacagttggccccttgaaacccgtggatacaaaaagttggtcctgcctgtacacgatttcatatcctgagaataccatatttttcaactgccttcagctgtggaggcagaactaagggacatggagggccaactatctttattggaaaaaatccacatatgagtggacgaacacagttcaaccctgtgttgttccaggatcaactgtatcaatattatcaatttaggaatagaaaagctgtagaaagtaagcattcattgatggtaaacattgtatccatttaaataccaaactaaggctaaacagctgaggggctcctggttagagaacagaaggtaaatatcctaaaccactagagaataaaaagaaatggcttatatgtggcaggggaagggatatggggaaaggtatgcttgcccgagtttctacatctttcatagtcgagagtctgtggatgtagaataaaattggtaaatcaagaaataggtgtttcagtatgctatttaaagcataatggtaaccagttcaagaatgaaaaccagactataaaccttccaaatcattagaaagagagaaaacattaaaaataaataaataaataaataaatagctcacaaacaaaacaaaggaaaaaacagaaacttcaaaaatataacaaaaagtagaaaacaaacatttcattttaaaaaagagaataaaataagatgacagatttcaaccaaatatatccaacagaacattaatggaaacagaatgtacatttctacaaaaataaagatgttcaataaaagtataagttacaggccgggcacagtggctcatgcctgtaatcccagcactttgggaggctggattacttgaggtcaggagttcgagaccagcctggccatcacggtgagatgccgtctctactaaaaatacaaaaattagctgggcatggtggctcacacctgtaattccagctactcaggtggctgaggcaggagaatcatttgaacccgggaggctggaattgcagtgagccaagattgcgccactgcactcctgcctgggtgacagagcaagtctcaaaaaaaaaaaaaaaaaaaaaaacaagctacagaaaaataatattatattacccgatttaggccaaacaactacctatacagggtaattccccttatctacggttttacttttcccagtttttagttaccagagctcaatctcagttcaaaaacattaaatgaaaaattctagaaataaacaattcataaattttcagttgcacattgttctgagtagcacgacgaaatctcgtcctgtccagctctgttctcccaaaaacatgcatcatgctttgtccactgtacccacgctctctacactacctgcctgtgagtcacttagcagccatctgttatcagatcgacagtggtggtgtcacggggcttgattttacttcatcatggccgcacagcacaagggtagtgatactgacatattattataatcgttctattttattattagttcttgctgttaatctcttactgtgcctaatttataaattaaacttcatcatatgtatgtatgtaattggaaaaacatagtatatatatatatagggttcagtactatctgaggtttcaggagtccactggtggtcttgaaatgtatccccctcagataagggggctactgcacatccagccgtccttatgtatgcttatttatacatagaaatttctgggagccctccaaatatattgctaattgtgattagctttgggaaatggtgctggaaagatttgaggaggagagggattctgttcttcactttatgccgaaaacatgtagtacacctgtattttgaaatgtaatttaaatatcaagtgtgtataatataatatgaaaaatgccataatggagactctacaaagacagggctttgggaagtgatgggagagaggaactaattatgactaattatgcctgaggaagctagaaaaggcttcagaagagcgagtgacacatgagctgaactttaaagaatggctgtcattttttgaggttcagatcaagcagacaaagcagaagcagcggagacagaaaagcacatgggtctttcacaaatgacaaggcctccagggtggttggagcccacagtgagcgtgttggtggcctgcgtcggaggcttagtctgctcgtcccagggcctgaatgcatgctaataaacacgctgtgctggagtcagaaatgatgcagaataaagcaaaggtcatttctgggtagaggaccaaaggctggccatcctctgagctccagcaggctgatggggatgcagaggtggcttcccagggcttccccacctcccaggctgctctgagtctcagatcctcaggaccaggcagtggttgtttgcagcagtttctaaactgaaggacctactagctcatgtgttgcattaagattctttgagctgtgtgtctgctgcactctcttctctctttgcagaccgtcctgtttttttttttttttttttttgtctttttgtcttttcttttttgtatcaatgacaaacaaaagcaaacaaaaaaaaaacaatgaccacagcagctctagagtaacatcactttttcctgcaaggctaccaattaccccagttgttttcttgtttttgttgcaaatcttcaagagaggtgatctgattggcctgcatgactccagggtccaaccctggtcccacctgctaccagtgtatttcctaccagggaaaataaactttcaccccaggagctcattccatggatggaggtgacagacagttttcagagaatgtggtgagggcctacaggtgtcttctagactctgcccttattggtgggtatcttagcaggtggctgcatttcttcctgtttgcccctctctctctgccccatgcctcacttatacttggctttttctctccccgccaccacccccagaactaagccggctcacaagattctgaaggcagcttagccaagcgtttctcccccataactactttgctctcattctcctctgatctggagtaccccctgcaaagtctcccaatcccagtcttcaccctcatctgattcactgaaatgccctgagattatgggcgggtggatgtagaagtaaccatactttccgggaaggcaaacatctatttctcttctgttaggcaagaccttacctaaatcctgccagacacacaaatatatggcttgtttttaaaagttccccagaaaagtaaaggcagcccatgtccctggctactccttcccagatccacctgctaagggaagttctctcttacaactaaccaggagctcaagagggtgaccagctgcctcttgctcagtcttcatgggtggcatcctgttggccaatatgacaagcacagcgctgtcctggcagtagtcttcttcctgattttgaatcaagctgtgttgatgttccacagagcccagggtatgggtgaaggaaccggggcgcccagcaaggccactggtcagtttctgtgagactgcaggagtgggaggggaatgaagaggagtgacgttctgtaggagagaaaaaagggaggcaagcatggactgagaaaccaagctttaaaggaggggcttattccacaaatgtgtcaccccaagctctctcttcatcacattttggctttcccagcagcctgagcccacagcctccccatcctgtggggctcaaattcactgccacctcctctttcctaccagtccagcctctgcctctggagtgtgatgcttatggacctctctctcccatttgcagggggcaggctcatgagccctcgcttcccatgtgggcagaagaaatgaaggtaaatttgtctctgccctagaatcagaactgtcccctggtatccttccttgatcatctttagcttcttcctccctgtcttcctgggagcacctgatcagcctttcttcctgccacagctcccacctggtggagggatgcagggaaggtggagaattcccaccactaccacctcctgatatcgcctgcctgacatgctggggacagtgcagttagtaaactgggggcattgagatgtggaaggagctcctgagcacagggaaaggggatgaaactgctgctcccatgagagtgaccccatccaaataaggccataacagctggctcaggtccatccgagcctcaggaatccaggctcacagtggtgagaagagagtcagagaggaggttggtgtggagaaagagtatgtgctttgtgagtgtcttaatccatttctgctgctatcacaaaaataccatagactgggaggctgaaacaacaaatgtatttctcatcattctggaggctgggaagtccaaggtcaaggcactagcagatccagtgtcttgtgagggtttgtttattggttcatagatggcaccttctagctgtatctccacagggtagaaggggagatggatctctcttgggcctttttcctttttttgagacagtctcgctctgttggccagactggagtgcagtggcacgatctcagctaactgcaacctccacctcccaggtttaagtgattcttctgcctcagcctcccaagtagctgggattacaggcacccaccaccatgcccggctaatttttgtatttttagtagagacggggtttgaccatgttggccaggctggtctcaaactcctgacctcaggtaatcctcctgcctcggcttcccaaaatgctgggattacaggctgagccaccacacctggcctcttgggcctcttttataagggcactgagaacccattcatgaaaaactctgccctgatgacgaatcacttcccaaaggccccatctcctaacaccatcacattaggatctgggacttaaatgcatgactattgagagggcataaacattcagtccataatgaggaccagacaatccagctctctcctcgaccctcttggtgaccttggacaagccacggtctctgggctctagtctcctcactattaaaaaacactaagaacactcggtgcccaataaagagaagctgctgtaacttttgtcatttaggaaacaaagaaagcaggtaagaattccagttcctatttgtgcctccccaggagacgccctggagcaaactcagggccagagtatccccattcctttagagcaggagaagatcacagagtaaaggtcactgggcagaataaatggcttcctgtatcttactccaattctcatggtaccccgtgacacgggagtccctgttttacagatgcagcaacgaaggctcagagcagttgaatcctccacagtcacccggccattaggtggcaaaactgggattcaaaccaggtctgtctggctccaatgtccagaagtcattcattttccactcctcactttccactcattctgacatgcagcgagggcatagactgctgtagtctctgccctagactagacttttcagctgcccaatctccgcagagatgctcccttccctaagccatcactgtagtcttcaatgtacctgctacccccactacccctagttgtaccaaaagttagatgagaaaagaaatgattttttagattgcctattatgtgctgtgtgtttccaccacaaatcccaaagatacatatgattattcccattttgcaattaaagaaattgaggcttggggtcttaggtcggttgcccaaggccccagtgctaacacaaggaagagcaagcattcaaacctggctttgctcacccccaggcccctgcctacggctgcctctccctagacaccagcccaagtattttacccgctgaggactgcttcaggacaaccaccagcaccgaaaaacacagcccagcatgggaggcaaaaggaggcttccatccagcgagaaaatcaagaagcgtggctggacagccccaggcagggaatttgggaggaatgggagtggtggaggacaaggctctgcctgaggagcaggtgaaaaaaaaaaatctctttgaaaaactgggtacagagacgtggaatgaagcatgggctaccatccaagctttgggatttaggttgttttccaaattcctatcagaaatcctgtaattgaaagggattgaaagcaggtcattatgtcccaagcagcagacagagaggatcaagagttttcaggctgcccagagccagctaacaaagggaaaaatatttctctttcccccagatattaacccagtaacattcccacctcgggcaagacttcctgccactgaaaaatatatatgttgaccaattttgaacgggaagtagcagaagtaactgttcacccagccagtagaaccagaagcacaggccagagcaccacgctaaggcctcaggattgggagtttatgttctcatgagccacagacgcatggagtcacttatgaccccctgaccttcagtttcctcatctgaacatgcccaacatggaagtggggttgaaggtaccactggacattagagttgatacatgtatatagacgtaagcgtttactcagcagcattcaacgtattgagtgctttcaaatatagtctgacatccactggggatatacagaattgaacaagactgactcagtctttgtcctggaggtcccctggagtctcaaggaagcagtgtctgggaaacaaataagggtagttgatgactgaactatggctgtgcgattgctgtgaaggggaatcacaggatgacctgacctgggatggtgacatttgggctgagatgataacagtaaaaatcacaacagccgacacttacatggcacttaggatgggccagcactattcagagaccacagggattctttggaattaacaatagggagagatgtgaacagagaatgccagacaggttgggaggcatgacaaagtccttgaagcgaggaggaaaacagcaggttcgaggacttgaaagactatagtaagggggagagtgatacaaggtgagctcaagagggaggcgggagtggagcagggtcttatctactctttggaaaccaaccaaagttttaagcagaagaatgacaggaccagagagtagttaggaagctattgcaatgggcctggcaagaggtaatgggggcttagacttagcgggcagcaatggaaagagagggaaacaggatgaaggcaaggtatatttaaaagggagaccggccgggcgtggtgctcatgcctgtaatcccagcactttgggagatcaaggtgggcagatcacttgaggtcaggagttcaagactagcctggcgaacatggtgaaaccctgtctctactaaaaatacagaaaattagccgggcgtggtggtgagcgcttgtaatcccagctactcggcaggctgaggcaggagaattgcttgaacctaggagacagagattgcagtgagccgagattgcaccattgcactccacctgggcggcagagcgagaattccgtctcagaaaataaaaataaaaataaataaataaataaaaacaagacctactgggtattcatgtttgataagtaccaaggagaacactcagcctgggcacctggggcagtgctggcaccagttttctgagatggagaaagctataggaggggagaggtgatggcactgcaatggtcagttctggtctgagaagcaacaactcctctttgctccacttccagctctgctgatatttagttgtgtgactctggataaggcatttcataacatcaaaatcaaatggagcggctgggccaggtgcagtggttcacgcctgtaatcccagcactttgggatcctgaggcaggcggatcacctgaggtcaggagttcaagaccagcctggccaatggtgaaacaccatctgtactaaaaatacaaaaaattagatggacgtggtggtgggcgcctgtaatcccagctactttggagactgaggtaggagaatcacttgaacccgggagtggaggttgcagtgagccgagatcatgccactgcactccagcccagatgcagcagagcgagactgtctcaaaaaaaaaaaaaaaaaaaaaaaatggaggagcagctggactggaaaatctgtagctctcctttcagcaccaaactcaatggctctagagcaggcatttcaaatgggtgacttgggaagctggattcaggaggcatggagtggtttatttgacccacacatatcagtgtggtaaatccccatagcaatctaaatctctgacttttcttgaaaaaaaaaaaaaaggagatgtagaagatgtacaacactcagtctacgtcagatccccacatggcgatggtcggcagagttgagtggcagctgtcactgcaggatacagactctcctcctgctccaggaccctcatccccttccactcacccacatgccccacatgacacctgttgaggataataccctttttctatataatgataagagagtaactcaaatcatcagttatttctcaagcttatccaacccatattcgctaaattattccttttcagattaaaaagaaataaaaaagaacaagaaaaataaaaattaacattataaaagcctcttgtaattccaatacccagagaaaatcgccatgaaattggggtgtgtttcctgctagttttgcttgataaaattgggatcatattaaatgtgttttttaatgacttttttctcactaatactataacaggcacattttcccatcctattaaaaattctttggaaacataatttggaaagactatataatttgctgaataatttaagcaattattccaccatcatttcttaaatttgtagatacatctcaactctgattatttcttaagacaacttcttagaaatgggatgatgaggtcaaggcgaatgttatacagtattgcatcagttaatgactgggttatgtcctgagcaatgcatcattagccaatttcgtcattatgtgaacatcacagagcgcacttacacaaacctggatagtctagcctactacacacctaggctagatgatacagcctgttacttccaggctacaaacctatgcagcatgctatgtactactgaatactgcaggcagtggtaccacattggtatttgtgtatctaaacatagaaaaggtacagtaaaaatatggccacaagataagaagtggtacacctgtatagggcagctccattacaatcttgtgggaccactgttgtatatgcggttcatcactgactacagtgtcgttatgtggcacatgactatatttctgaggctttcgaagtgttgtcaaattgccctccagaaagtttgttctcactttcatcattcatcttgctaattttgggatgttatcactttagaaaaactccttgaagaagttttccaggtagggatataggaatcacctgaggaaaccctgctgtcaacagaaaccctaccttgtgtttgtagagcaggaattgtcaaagttcttctgtaaagtccagacagtaaatagaatgggaaaatgcccttgacataatgttacttttctgcttgccggccataaagtctgtcacctggctccgctgctgtagtgtgaaaggaatgtagccatatataaacaatggggcatggctgtgtcccaataaaacttggtttataaaaaaagaggcagtggaccatatttggcccatgagccacagtttgccaattcctactttatctcatttcgtcctcccaacaatcttgagaattagatagggcaggaaatgagtgtgcctgttacactgatagagaaattggggctcagagaaaccaagtaactttttgacggtcacactgctagtaattggaagagccggaacttgaacccacattttctgacatctgttttagagctctctttattgcattatgagccccttttcatgaacgtgtagcagtgacagttaaaaagccatgaatgtaaaaaacatccaaggcattttgccaaatgcatggtgtgcttgagggctcagagttcagcaaggggaatcctaattcaatgctttcaagtgcaagaaattgctctgtagagtgccttgcattgtaaagagttagtgttaatgcaatgtttgacaatgatgtggttgctgttttagaaaagagcttggtgatggtggaaggcagctgaattaataaactccttcaaatgaaataagaaaaaacccaactccaagtagttaagagaaaaaggaaagtcattgtttttgtttcttagaattccagggccaatggcttcaggcacagctggatctaggacctgaaatgatgtcatcagggctctatctctgtctcctctctctgctctgcttgttcctgcttcattatttagattagatcactttatgtggtagacaagaaggcttctgcaagctccaactgtgttcaaaagaaaggaagactcactctcctaacgccttatttcagtatttcacagaagaactgtgatcgtcccttcttgggtcatgttcccccactggatcaatcattgttcctgggagggatgcagcactctgattaaccactgttgtttgggaatctatgcatcatatttgatgctcaattgggatcacatgggtgggataggaattgttccttttaggaatgaatactagtggaccaaaagtccacgaatgcagcaaaacaacaatctgaagagacttgcatccatccattcagtgagggccccagtagcaagagaacctaagaattctcccagaaactgcagtgttagcttgcttgctagtgtacttctagactatgaggggaaagtagagaagggtattgttatgggttaaattgtattccccccaacacacataaaaaaggtaaggacaatgacatctgcaaggacactatttccaagtaaatacttccttctgaagtactgagcattaggaccagcatgaagacatcttatagatgtcaccacaatatcactgttgtccttatagaagacggccatgtgaaaatagaaacacacgggatcaccatgtggtgacagaggcagagactggagtgacacagctgtaagccaaggaacgccaaagattgccatcaaccaccagaagctaggaagaggaagcccctacttatttcagacttccagcctccagaactgcgagaatacatttctgctgtttttaaaccacccgatctgtgaagcagagctacaggagccctaagaaacaagcattccaggcagaagaaatggcaccaggaaggagctgagggcataaaaagtatggccatggaagcctagagaggagagagttctaaggaggaggggtttggtcagcctgatcacctaccccaggaagggggaaggcaattaagaggcagaaaatgtcatcaacatcatctcctgcactgccccccaccccgctcccctccgcagaagaaagagcaggaccacaccattgatatggtcatgaattatttcactggcatgacacaaacaagctcactccatcatcacttgctgtgagtcaccatctggcattttattggctgagcttcttgctcctctgcaacccgcatcacacctatttgtccactcttgcatggatgaccttccagttcttggaggaaagaccctaatgtagatattttcaagagcttggctcttccaggaaaagtggccacaggtgcctggcttcaggtgccctatgcaaatgtttattcttaacggaatgtgtcacagctagcctcaccaaggcaccttccaagggcatatctgctaaatgataacacatgggtaccacaggagagctctgtctgggcttctccaagagtttcttcgtgtgcctttacaagggcatgtgcctacctgcagtccaggcatccaccctattggtgaaaaataacatcacccagaataaatactgattcgtcaaacgctgtgcaataaaaaccttctcttctttctactcaaagcctcatttacatccagcgatgtcaaactacttaaacaacttaactccaatccaagtgctgggactaataaagatcagatggggtctaaagagataatgtatatgaaagcctagcaccctctgggtgctccgtaaatgctactgcccttcctccctggcttccagggccttccaccctagaaggggatgagtcgtcctacatctaattcctgggtgactgcagtaatctccagactggtgtccctgcttcctcccttgcccttatccttatagtctattctcaatacagcagccagaggcatcttgcaaaatgtaagtcaaatcatgtcactcctctgttcaagatcctcaaaagatcttggctctcaaccagtctctcagtctctacacgattgatatttggagctggataattctattttgtgggggcagacttgtgcattgtaggatgttttgcagaatccctgacctttgcctactagaggccagtagcatcccacccccactcccaagttgtgacaaccaaaaatgtctccagacattgcccatatcccctggggtcagaatggcccctggttgagaaccactcctctccaccctctgcaacccctgctgcccctcatctcccgtgccctctcctccctcacttcaccaagctacatcgtctttccccaatcccacatgactaactctcttacctctgctaagtctcggctcaaacatcaccatcataatgtggcttcgtgacagctgtatttgaaattgtgtccaccatcccatacctccaggactctctatcccacttgccctgcagttcatttcatacctctttttactttctagtacttcataacttgttttatctattgatcgtttttagtatgtctcccacaactagaatataactatctacatgccttcatgggcttttgtttgctatatccactaatgtgttctgagtgcttagaacactgcctggtgcataggaagtgtttgcaaaatatttgttgaataaagtgaggtactattgtgaatggtggattgagtcagcagctgcaacagccaaatagggtggagaaagcactgtcttcctggtcaggtgagctgaagtccagtcttgccctggtcacatactgaccaggaacctcagcctctctgagtcgtggttttctcatatggtaaatgggatcatatgtgtgttccatggctgttgagaagattagaggacatgtaggtgaaagtgtatctagaacaaatccaggcacaaggtaaatatccagacattgccaaatatcccctggggccaaaatggcccctggttgagaaccattcctctataccctcaaacctgccaggcaagccatttggcactatccctgacctttgtctactaactcgatgccagtagcatcccaccccccactcccaagttgtaacaaccaaaaatgtctccagacgttgccaaatatccctggaggtcaaaatggccccctggttgagaaccacttctctacaccctctgcaacccctgtcgactctgccacctcatctcccatactctctcctccctcacttcaccaagctacatcacccttcttgccattccttgagcctgccaggcaagctcccacctcccttatcatggcaagtgatatgtgaaacatagaaaagattgattgtgctgagctttaaataagaagtagaatttaacaagtgaagatatgtggagaaggggaggaatcacatcttgctgagtttcacagctttcttctagagcatagaaaaaagtcagcccagcctgcatttctggagctgggacatttgatgttagcaatagcctagatatatggaaggaacctcaagagagaggaaaaactaagtttggaaatcctttgatttttgactttagatgttgactttgaaatatgccatgaacataaaagagaggataatgaatggagttggacttgtagcttggcactgaaatttacaactctgaacaaataggaaattctgaatccaaaggatgaaacctactagcaagttgagtacacaggattgccttctggaacagggagtcaacctagatctaaggaggctttgttgggcaaaccaggtaaaccagttggccagtctgtgcaagcaacggtgtgagagtgctgtcagccagatcccatcccattcaacaaggtgtcttgatttgaaaaacacactgaactagatgctgtggaatacagacaaaattagagcatgacctctgtcctcaaagagttgacagtcttctggggaagacaaacaagggaaaaacaaacagtactatcaagtagaattaaacaagtgcatgaattcaggcagaggcaaagggtatgggagcacagagaagggagtgcataattctgccataaaaagtcaaaggagaccacatggagaaaattgaatttgagctggagccacagaaaaggaaagagaatatctgaggatgtggctagaatgagagatttatccaaggcaccatggcgagctgtagtttagaagtaaataaagaaggacttttagaagtagaaatcaataattatttattcattcgattacagaatattacctgaacctctattacatgtcaggcattgaggtgctgaggacataaataaagcagactaggctctgccctcatggagtttatattctagtgggagaaacagagaagaaagatatagacaaggtaaataatcaaggtaatttagtaaaataagcatgaagaaaactactgtggaagctgtaagggataaatttccaaaatatataaggaattcctaaaactcaatagcaaaaaaaaaaaaaaaaaaagccaaaaaacaaacctcacccagttttaaagtgggcaaaaaccttgaatagatatttctccaaagaagacatacaaatggctaacagatatatgaaaagatgctgaacatggctaatcattaggaaacaaaaatcaaaaccacactgagatatcacctcacacctgttaggatgttaggatggctgttattaaaaacaaaagtgttgatgaagctatggaaaaattaaaatacttacacactgttggtaggaatgtaaaatggtgcagctgctacagaagacagtatggaagttccttaaaaaaataaaagtagaactaccgtatgatccatcaatccctcttctggatatatatccaaaagaattgagatcaggatctcaaagagataccttcactctcatgttcattgcagcattattcgtaatagccaaaatatggaagcaacacaaaagtccatcgacagatgaatggataaagaaaatgtggtattgccaggcgcggtgctcatgcctgtaatctcaacactttgggagaccgagatgggtggatcatgaggtcaagagatcgagaccatcctggccaacatggtgaaaccctgtctctactaaaaatacaaaaattagctggatgtggttgtgggtgcctgtagtcccagctactcgggaggctgaggcaggagaatcacttgaatttgggaggcggaggttgcagtgagccaagatcgcaccactgcactccagcctgggtgacagatcgagactccatctcaaaaaaaaaaaaaaaaaaaaaagaaagaaacaaagaaaaaagaaaatgtcttctgctcatacaatggaatattatttagccttaaaaaaagaaaaaatcctgatatttgttacaacatggatggatctggaagacattatgctaggtgaaataagtcagctacagaaagacaaacactacatgattccccttatatgaggcatctaaaatagtcaaagaaatagagtagcagttaaatttcagagtttaaaaaagaagagccagcaaagaatatgaaggaagagaagaaaaaccataagagttgtcctgtcacacaagctgagatgaatagtgttttgcaaaggagaggatggctccttagtcaaatgcttctgatgaaagaagaaagaggaggaggaggaggaagaagaggagatggagaaggagaaggagaaaaagaggaagaggaagaagaggaagaaagaaggagaagaaggagaagaaggaggaggagaggaggaggaaggaggaggaggatgaaggaggaggaggaggaggaaggtctttcaacgacaaggatgatcttagtaagagtactttcagtgaagctgtggggacagatatgtggttagagtttgttgtcctgcctggactaattgttgagggaccttgcctggatgtggctggggcgttctgtgtgatctgacatcacacatttggagagaagtgggaatagacaggagagattcagaaaggaaaagggacatctgagagcccacagtgagtttgtgctagactggactgggccgcaggtgcctggattctcctgtccaatgttctgcttcactccattgactggacttccattctagagtcaaattcatttccaccttttctgtaaggctgtgaccattacaacacccaatcccagcctgaattcagccacgaatctccccagattgggccagttcctaaagatgcctatccaattgccaaatcaaactctcattccaaccacacctactattcagctcctgggaacttcctgcctccctctgaggcctcaccttcctcatgacactccagcagaactgagctctttgtagttccctagacattatttacatctccttacctttgaccatgctgtgtcttctgcagggaatcccttgctctgaattcctatcaacatacatgcctatctgtgtacacacacacacacttctctccagcttgcttttcactcaatcttgtgtctttttttattttattatgattattttttttttccgagaaggagtcttgctctgtcgcccaggctggagtgcagtggtgcgatgtcggctcactgcaagctcaacctcccaggttcatgccattctcctgcctcagcctcccgagtaggtgggactacaggcgcccgccaccacgaccggctaatttttttttgtatttttagtagagatggagtttcaccgtgttagccagaatgatctcgatctcctgacctcatgttccacccgccttggcctcccaaagtgctgggattacaggcatgagccaccgcgcccagtcaatcttgtgtcattttgatatgactctaatttgtttctttcaatggtttcaaaatattctttgatgtgattgagccacaatttattccaccagtcccctaccaatgaggatttatggtatgcacactgccctgcagtcttccatgaacaatggtacagtaaacatcctagtacagatgtgttacatactagcgcatttggaagggtcttcttcccctggcacactcctcgaaagctggatagaggatcactgcttctgaaaaactcatcaccgattacccagaaagagtgaattcctccttcctctaagcctccttaatcccaggtgctagagcattttcaggggtatgtcaaagcttctggtaagctcctccaggataggaacagcgttatccatctctgaagcccctgagtctagcattgcgtctgccacaacatgtatgtccaatatgtatgtgttgagtttaattgcaaagaatttgagctttgaaaccatactgattagacttcaaattgtcgtggttctgtcaccagcctctgagctttgttttctcacctgtaaaggggaagaataattcccaagtgtgcatggttctcagaaggatgtgatgacatcatgtagagctggccgcacaaggcctgtcacgtgggtgccatttgaaaatggaagctgttggctgggcacagtggctcacgcctgtaatcccagcactttgggaggccgaggtgggcagatcacaagatcaagagattgagaccatcctggctaacacggtgaaaccccgtctctactaaaaaaaaaaaaaacaaaaaattaaccgggagtggtggtgggtgcctgtagtcccagctactcggggggctaaggcaggagaatggcgtgaacccaggaggtggagtttgcatgagccaagatcgtgccactgcattccagcctgggcaacggagcgagactctgtcaaaaaaaaaaaaaaaaaaaaaaaaaaaaagaaagaaaagaaaagaaagaaaatggaagctgttatgattggtgtttgtctggagaaggaggctacactgagactttgcactggcacagggccctgtccacacacctccgggcttctgcagatagggaaactccctaggacaagctggcagttctgacaaatgcccagataaatcttgctggtgccaagctgtctgggacctgttgcctctgcccagctccttccaaatacccaggcccttccctgatgagatgactggcttccagccctgggatacgccttaatgaaccagcattgtggacatcacccagaacttctctgcaagtggacacactgtgaaggcaggaggcttgatgaaagacagtatttctttcaatatgcgtgctcaagggcaggggctgggagggctcctcaggggagatcttgggccagtatcatctgagatacctttcaggtagtcttcatcctcagagttcatcctggggctggaagagtgctctggaccactggataggggattgaccacacaatgacagtttggatgagagctgaacaatgtcttcaagacagatatttcctccagttcacctgtggtcctcatgcaacaacaaccagcaggacacctgggctctgattaggtttctggccatcatggggctcctagggcaaaggggaaattcttccccctcactgggtccctgtctgtgatctcgcctcccgctcaccacttgctagctcagggagactttcatcaagtttgcagtgagaagaaaaacaacaaaagcaggcaactgaatctgtcagccttcatgcagcttagctggcttttagcttaataatcagaaaagtggcacctttgatttcagattccatagtaacttccttcccccagagcagtgactcatctctctagagggtacccttgggtgaaagagaagaaacgtgttactctggggctggggtggggtgcagagttgcaggaggcactttttaataacgtctccagcatcagcccagcacaccagatgccagctgttctcccagtgtctccagaatcaccccaacctaagatgccatgtcccaggcagctgaacaatagccctaggttgctgcactctgattccaggagaggatgtggcaagcacctgctcctggctctcccttctcagatttggtggtggttttgaaaagacactaagcagggacagggttgtgttaggtgagggtattttgtcaggtctggaagatatatgacaaggcttgcaggtggatggtaaattaacaaacccacaagatgatacttcctgctgactgtccagccaggtcaggggccaaagaaagttctccggcccatttggactcttaccaagcctagaggcctcctgggacattgcagagttttctctctacccttagtttctgtttcaaccacatttgtttcttccatgaaacaagagctcagactagagggaaagtggccttagattcagacagaactttgttcagtctttggcccggcacagctgaggtgtgtgacaaggggtacatctgttacctctctgagtctcagtttctgcatgagtccaactataatcatatcaggatctcctccatagggtttctgtgatgattagatgagataatggatataaagcgcctgcaagttttggtgtctggtacacgttaacgtatcaatctaagctagtgatgatacccatgctgatgatgacaatgaaagttattaagccatcatggtgtattgccttgtttatcatctagggcgtgtactttacatacctatgtgtgcatacatatgccattatccctcttctctccattctggtcatctgcaccatcttagacaccctttgatcaaaaggaatgatgaaaccagagtgacgtttctgtgacatatcaaagggatccaattatcccatttcactgattggaatggtaaatcctcccaatcctgtacctgtagccaccatcattttcccattcaacaaacattttctgtgcatctcctgtgtgtcaggcattattctagcaactggtagcactgataggcattacctgtagcaacaaaagagagcaacagaagcaaagccccttccctcatgacatgaacattctggtggcagatttgcatgagaaatatgcaggccagagtccagtctttctatcagaaccactatcttcactggaacatcgctttcccaggtgcctccccaccccaattccaactccagaaccatccctcagggacagacaagactggctgcagaaatggcttccccaaagctggaagggtgcaattcacagcttggaaaacaatctcagtctctgctaaaccagaaacctggcatcacctttgacctctccttctccctctcctactctacccatatctaggctgccctccatctgggtcccctcccgcccagcactcatcccctgtgccactatccacactctcacccttgccatctcttgcctgggtttcagcaacagcctccccgcctttatcccctttgagtccaactcccacagagtagccacacctccacagagtagctcatatgcaatcgtgccactctggagctccatacccatcagggctcccaggagatgattttgcccccaggagaaagcctatactcctcagcactgtcctgcacatcagagccacgctcatttctctggcatcacctcatttggggaaacttacatatggtaaaaccttcagctgtattgaactcttggaactcaccatctttctctcatccctaagcctttgcacgtacaaatccttctgtctagaatacgccctctgcccctccttcatcctactaagcccaactcatctttgaactctcagcttaaatgttgcttcttcgagaaagccatccctggctcttcaagtcctgatggggtaccctcctgggaactcccatggctgccaaccttccactatcatggcactatgtcagatctgcctgttggcttgtctgccttccctagtacacagtgagcttcttgaaatcttttgtttattgtgcctgaaacatggaagacaggcttggtcgtttcatccatgagcaatgaccgaacggcccatgctctgcatcaagacccacagtggggagggtcctgctcagctgtgttgggggcaacccttgactcctgttgctgggtccctctctgggggaggagatagtgagaaggagaagctgcctccctcttcatttctgacacaacaccctatatgtgggaacctcccctcttccctcttccccacagctccatagagcatcccccttttcaaagcatgaccacctttgccaaagaacatcctacgtacccttaatcccaagaaacctacttcatcctgctgaacctactctacttcttaggaggcgaaaggaagagttattgttttgtgtttttctcaacacccagaaaggaatccacatcagattctgccctgagatccattttttcccacttgaaccccatctggggccctccaaaggggattgggcttcgtcctaaccaggtgccagccctggtaaaacaacagccacttctttctgcccacatcagtgtcagtggccaaccaatccatgtcccaatgggaggcgactatccacaaagctctctttctctcgccacttctgcattatatagaattcccagggaggggcctgggtctgtcttcttgaccaaggccaaggggctccccaggccccacccagtttcccaatgtgggaaccaccccagctggccgcctccccagctcacaggctgcagggagaaagaaagggctgttgagagtgattctgggttcccacgcaggaaggtgccagctcaagacagcgtggctttgtgcttgggagagtctgtcttctcaccaggcggagggacatagcagcctgtggagagatcagagagatagcaaaggatggcggggccatccctgccccaagcagcaggaacattggaagcacacgcctgccctaggggagaagacgcctgactccagacttagcgctgagacttctccaagacaatccatttctctgcagccccacacatcagtttctttacgttgatgactgctcactgagaaaatagctccaaaccaaaacataccatgcatcttaattttattcctcatctacatatgtttattttattttattttttgccagatagtctatgtttgcattttatttttacatgtatttaaagatggatcagtactgtatagatggacccaaggatgggcaagacattgtgtattaatagggctatgcagacctttttttaataaatgcagctccctggggatctacagatgttcttcatcttccatcactagtgaaaggacacatccagcctgctggccatgatggatgggggaggaagagcaaaggagggtagaaagtctctcatagttgtttagactctcttcattatgacttttctctgtaacaactgctgctctccagaatttagggctcaaagccctggaaagttcccaatttgaatggaaccatggatgctgacaacttgtgagggacacttgagatcatccaatccaacaagctctggagaacaaatgtgactccgcatacactaaacgtgtgtgtgtgtacctgtgtgagagcgtgtgtgtgcacctttgtgagagcatgtgtgtgcacctgtgtcacagcgtgtgtgtgtacctgtgtgagagcatgtgtgtgtgcacctgtgtgacagtgtgtgtgcacctgtgtgatagcatgtgtgtgtacctgtgagagcatgtgtgtgcacctgtgtgacagcgtgtgtgtacctgtgtgagagcgtgtgtgacagcgtgtgtgcatctgtgtgagagcgtctgtgtatacctgtgtgagagcgtgtgtgcacctgtatgacagcgtgtgtgtgtgcacttgtttgagagcatgtgtgtgtgtgtgcacctgcgtgagagcgtgtgtatgtgtagctgtgtgagagcgtgtgtgcacctgtgcgacagcatgtgtgtgtaagtgtgggtgtgtctgtgtgtgtgagggagggtgtgtttttaggtggatgtgtgagtatgtatgtgagatgagtgtgagaggatgcgggtgagtgtgcaggtgagtgtgaggaagtaagagtgagtgtgggtgtggatgggtgtgtgtatgtgacaggaggtgtgtgaatgtgtgcgtgtctgtgagcatgggtgggagtgtaagtgtgtaagagtgcatgtcaatgcatgtgtgtgtgtgaaaatgggcgggttttgtagagaatggaaagaagatctagtgaggatccctagcaccctaacccgtgcaccccaaaaacctctgtaaacgaaaaaaagctttgaaaacaactgagctagttcaagctgatttaacatcatcacttgacagatatgtaaactgaaacccactgaagaaagagatgtgccaaatagccttatggtgccagggctagaatccgcgtctcttgacttccacccggtccaccacactttgctccgttgtcaatagaattgctcttgctattcctgaacaccgtagtggtcacctaggggtgtgctgtcagcgctgcctttttaggaaggggggaatccccccatgccctcctactcaccacgtcccacacttacctcattactccagacattcatctcatcacttacgataaaagtagcacatgctcgttatatacaatccacatagccacattctgcaagaacagttcttttgcacagcatgcttcctggcaatgactgataggtctctaggaagagcagctgaaccaagattggccagttagagctcttccctgagagtcctcacaacacagtgaagaaagggagtcatccctcttcaatgcctaatgctgtaagatacaaaactcaccttgtggaagaagccacaaagccaccataacaaagactgaatccaaacgatagagaagtagggttaaaagacagcagaggatccctctttccagcttttcagagacccagcgtcatctctggtcttgctgtaacttgaatgtttagtcctctctctgttttgtgcttatattaattaattaagcaggatcttttcccccctatagcctaaagccaaaatataccagtgtaatcagattccctcagacttttttgcatccactcctcaaatctctattctcctttttatgaaatgtattttactataatataaaaatcaatgcatgtgagggagatatatctagttctaatttctatattgggaacaagagaacttagaagcgtataagttaggggaaaagatggaaataaaacaaatctcattaccaatcctgaaatctttccaagaagccgtgatgatgtatattaaatggtataagtaacagaggcccaaaataatattccttaaacatgatacaagtttaattttcttatgcagtgaagtccagaagtaagcagtctggggctagtataatgacactgttccatgaagacctcagggagtcaagctccttctagcttgttgctttcattgcattctcagttttcttatctgaaaagtacaggtattgctatacctgcctcatggcccaagatggctgccctatcctgccatccaatttgcatttcatccaacagaaagaaaaaaaggatgaagaagaagggagagaatgtgtcagctcccctttaaggaagtctcccagcagttatcagatgacacttccacttaaatcttaccagaacataatcatatggtcacaactaatttgaaaacagtctggaatatacagctttgactctggacaaccatgtataaaactacaaattaggagttctttaaccttggaacaagggagaatgggcattagagaacaacgtgcccaccactgctgtcactgttacgctctcttcttttacagattctgccatctttctagtggttactccaactgtagcaaatgacagccgttctcttttctctgatgcctaatttgcatacaccagtgtttatgactccagactagagaaactagggtgtagagctagagagaataaaatgagcctcacttggaggttgggaccaaagggatctgttggagaattcaggaacagaccatgtggttccatttttctcttccccaaagatttttggctctaatcctcaccaacctgctggcccataaggaatgacaagctagaaagctcccccaacacacacctcccatccctattttattagagaaaaatatctcctgacaggatatcagagcattcagcataatttttggaggcagtaaagggtgtagttaaaggactagccttagtgtctaagaacccggtttcaaatcccagatctacaagcctagggaaattacttagcctatgactcagtttctgtatctgcaaaatatagatttacatacctgcctcataggatttttgagaaattataaaaggtaacctaagtcaggcacataatagtaagagcttaataaatgtcaactgtttttattcaatgtctcctttgttccagggccctgctaagaatgtagcaaatgcaagggtgagtttgtgaaatcatgtggctcctagaacacagggcaccatgagcctgggcccactctggatcctaaggggagtttcagcagcagcaatctgaacactggggcctttcatggggcagatggcaggtccaggagtgcacggggacaatgtgaagctaaaagccaacctctcctccttctccctgccctcatccccagatagactcactggaagcatttttgtgtagcatgcattacatttgggcagccctaattccatgctgtttgtccctttacatcagttctgcaatgggattgctggctccttgaaatacctgcagcttccaacaacaacaacaaaggaagaagggaaggcaggagtggaggaaggaggaggaaggaagaggggaaggagaaggagaaggagaaaggaaggaaaggagtgaagggaggagggagggggaaatgagggaagtgaggagaaacaaaactgattgtcattttcactgaaaagttaataacaatgtaacaatttctcatccacaggaagaggggaaagagaaggggaaaggagtgaaggaagggggggtggaaatgagggaagtgaggagaaacaaaaccgattgtcattttcattgaaaagataattatgtaacaatttctcatccacagtttcttttaacacttctaaacaattgattacttttaaagtaaaacctaatttacactcttcatgtatactttctacttctgcatctatgaggtgatttttcaaacatttatatcactccttgtggtaaaagtgtccttgtatacaattcaaacactgtgaaggagcataaagtaaagaacaaccaagctgggcacggtggctcacacctgtaatcccagcactttgggaggctgagtcaggcggatcaggtcaggagatggagaccatcctggctaacagggtgaaaccccgtctctactaaaaatacaaaaaaattagctgggcacggtggtaggcacctgtagtcccagctactcgggaggctgaggcaagagaatggcatgaacccgggcggacttgcagtgggcagagatggcgccactgcattccagcctgggcgacagagcgacactccgtctcaaaaaaaaaaaaaaaaagaaagaaagaaagaaaagtgatctcctcttggaagccttccccgatcctcttctttcccgaccttgactgactgacttttccaaaaacctaagcgaaatgcagaaggagagctctcttatatgatgccttatggagataaaaatgaacacatactaaagtatacagtggtatggatttggaaggcaacccagcaatttagcaaataaaaatgtgcatcccctttgacccagcaacccactttaaggaacttgacctacccaaaaacctaagcaagtgcgcaaagacggtgtgccaagactttgcaatacttttgtgtgatcagcagggactggtttaataaactttagtactataggctactccatgctgatagaaaaatatgtcaagatatttgtcatcttgaaaaaaactaagtgtcaaatgatatacatagtatgatcccttcagtcttacagaaagcatgatggaaggaaagagagaataaagaaaggggaaaagggagggagggaaggaggaaggaatgaaagaaggaagcaagggaggaagggagtgagtgagtgaggaagaaggaatggagaagaaagaaagggaggaaaggagtgagcgagtgagggagaaggaatgaaagaaggaaggaaggaagggaggaaggaaggaagagagattgtatgttaccctgagatttggttctaaagtctgtgaataaaacaaaaaggggcataatttagcagggtttcactgtgttagccaggatggtcttgatctcctgaccttgtgttccgtgaggagatcacttttcaaccagaccttgaaggatggcatggtattcagagaaacagacaaaggacattccaggtagaggctggaatatggagtcaaagacattcatggagcttggtcgaggtggggaggtggttcattattccttggtaaatccttggccatcacgttacctagaccacagcccaccgcaaggcaggcttagatatttgaacaaaatacatcaagacagacaaataagcaattacattccaacagggggaaacagacaatgaacagaaaataaagtcaactggatggcatgttagatggagataagtgttatggggaataaaaatcagggatgggagatggggaatgtgcatggggagcagaaggggccaccgtgttaaacaaggtgaccagagaaggcctcatgagaggggttacatctgataatgacccatagcaggtgaaggaaggagccttccagattcctggggaaagagcattccagggagagggccagcaaggacgaagggcctgaggtgggagagtcctcagtgagttggagaaagagcaaggtggccacatggccagagcagagtgagagaggggacaaaggggacaagagagctgaagtcctaaggccctggtgctgaatgcctgaaggtgtcaggctctgtggcttgtttggattgtttggtttgggttattctttagagtaagatgagaaactattgagaggttttgaatagaggagtgacacactccgacatgtggttcaaggagacccttctgggtaaaagagagatgaggaccaaaatgagaccaattcaaagattactggcataatgcaggtgatttgggccaaggtgaagcagtaatggtggaggaaaatgaccatattctgaatgtattttgaaggtagaggctttaggatttgctcatggattgggtgtgaggtgtgaaagatgagaaagcatcgagagagccgcagggttttgacctgatgctgccattaactgaagtaggacttagtttggagctgggggagagattcaagggctcagttacagatatagtgtgtgatttcgttggacatcagagtgcagatgtcaagaaagcagttagacatgttagaacaaattcagggagaggtcagggctagaagtataaacagatgagtaatcagcatatagatagtgttaagagtcattaggctacatgaggttactaaaggaatgagtatggacagaaaaagagaaaaggtctgagagctgacccctgagacacttcactgatacaaagtcaggaaggtagaggggaatctgtgatggcgactaagggagggcagccagcaaggtaggaggttgggtcctaaaggccaaaacacacaagtgtttgacagaagagcgcgtgattaaattctgctgctaaaaattcgcgattgcaaaaatatggaaccagcccaaatgcctattaatcaatgaaattaatggataaaaatctgtgatatatgtgagacatatatatatatatatatatacacacactgtggcatactactcagccataagaaggaataaaataatggtatttgcaccaacctggatggaattggaaaccattattctaaatgaagtaactcaggaatagaaaaccaaacatcatatgttcctcactcatcagtaggagctaggctatgaggatgccaaggcataataaggaggatacaatgggccaggtgtggtggctcacacctgtaatcctagtactttgggaggccaaggtgggtggatcacctgaggccaggagttcaagaccagcctggccaacatggcaaaaccctgtctctattaaaaatacaaaaattagctaggcgtggtggaacatgcctgtagtcccaggtatgtgggaggctgagacatgagaatcccttgaaccaggaggcagaggttgtggtgagccgggatggcaccactgcactctaacctgggtgacagaacaggctctgccccaaaaaaaaaaaaaaaaaaaaaaaaaagaattatacattatacaatggactttggggattcgggaggaaagggtgggaggggttgagggataaaagactacaaattaggctgggtgcagtggttcacgcctgtaatcccagcactttgggaggtggaggcgggcagattgggaggccgaggcgggcagattatgaggttaggagatcgagaccatcctggctaacacagtgaaaccctgtctctactaaaaacacaaaaaattagccgggcttggcggcgggcgcatgtagtcccagctacaagggaggctgaggcaggagaatggcatgaacccaggaggcggagcttgcagtgagccgagatcgcaccactgcactccagcctgggcgacagagcgagactctgtcaaaaaaaaaaaaaaaaaaaaaaaaaagcgaccaattgagtacagtgtatgctgctcgagtgacaggtgcaccaaaatctcagatatcaccactaaaggactcattcatgtaaccagacacctcctgttccccaaaaacctatggaaataaaaaataataaataaataaataaatgctgctgttaggtcaagaaagacaaggactaaaacaccgaccactagattttcccctgaaaactatttattacttttaaccaagtgctggccaagtctccctggccttggatggaaggcatatcaattgcacatcatcagccaagtactgattggatggtttcaattgcaaaggggaaatcttatctccaagtcataaggtgggatttctgacagaaggaagagcacacattaggtgaagaatgctagactaggaaggaatggagtcagatggcatgggcaccagtcttggtttatctacttgctccctgtgtgaccttaagactccctgtagctcttaccatcttcacatacaatatgatgggtggtgagcagagcagggttctctgagagacttttcatagtctcttctcaagtctaaaattcaaagacatttccctatcttagtcagggatggctacataatttgcaggatccctttttcaaaatgtgcagtgtggggggggaatgctgttaaagatactaaatataaagctttttctttccttccactatctctctcttgacttgtcataatgctgttttaattgctatttaatatcattctaggtaaaataaataaatgaaattttacattattcacgtggattttaccatttacttttacattgtgcaatgcaaaattttaaatgcaaatatgaaaacattgaactcataagcagaatcaataaaattacacaattcatatttcatagttcctacatgctgtattagtcagttcccacactgctaataaagacatacccgagactgggtaacttataaagaaaaagaggtttaggctgggcgtggtggctcatgcctgtaatcccagcactttgggaggccgaggcaggtggatcacgaggtcaggagatcgagaccatgctggctaacacggtgaaaccccgtctctactaaaaatacaaaaaattagccgggcgtggtggtgggtgcctatactcccagctattcgggcggctgaggcaggagaatggcgtgaacccgggaggcggagcttgcagtgagccaagatggcgccactgcactccagcctgggcgacagagtgagactcaaaaaaaaaaaaaaagagaagaaaagaaaagaaaaacaagttgaatgggcttacagtttcacatggctggggaggcctcacaatcatggcagaaggcgaaaggcacgtcttacatggcggcagcaagagaaaatgagagccaagcgaaaggggtttcctcttacacaaccatgctacacaaaactaactcaactgtttttatttcacttctggatgcacacacattcttccaaccccctctacttgaggcttactgttgagtaagtaaggactaaaagaaaagtgaactatgaattggcctacctttttctttttttctgtgtcatcatattcagtataaattattggctagtaagaaggaacatgagggaatctcttggttggttgtttgcttttctcagaaagtgattgtcttcctcatctgtaaaatggggatactttgtaaggcaattttaaaacagaaaattcatctatccactcatgtaattctataccacgcacagtgcttggaacacatatgtggtcagtaaatattttaagtgctaagaattcagtgtggctcaagttgggaggatgctgaggtacataataaaaataacagctcagcagtaattgagtatttattatgtgccaggcattgtgttaatgctattgtattaactcatttcctcttaatgacagccttatgaagtaggtatttttattacccccattttacagatgaggaacttggaaaggtcagtaacttggccaaagacccgtagccagttaagtggcatatctgggagtcaggcccaggtcaataagatgccaaagcatgtgctttggaacactgactatattggtcccatagttacttggtaataaaatcaaagtagtcaaagagctatggagggaaatgatgagttccatctggggaatccaagaaaggcactgagaaggcagctgtatgtacacgtctgtagctcaggaatgatgaacagactatagataagatttgggagtcctcagctgaatgatagccactgaaaccgtgaacatggatatgagttaagataagacagccctatagaactaaggcatctgagagccaagggaggagaaaagaatgccgaaaaggagacgttgcagaggtaggagtggatgcatagggggaatacctggaaacctgtggacattaattcacatgctacagagatgaccaatcagatgacaactgcaaaaagacctttagattttgcacgtgtccccacagatgactccgggtaaaacagactccctagactggtagataaggggaaagggacaatggagagatttataactaaacttggtatgacttttcatctgtcacattccatggaaaaaaattatcctttgtcaaactacatttcctgacttggaggctaagaaaagtcagtcactgcagcaagatgcaagatgcaacttggctgtggacatttgccaagccacttacgtcccctcttgaggcctcagtttcctcatctgtacatagagttattggatgagacatactctaagttttctcccagatccaaaattctattcccttccgttccagatgctctttgaggatgttggtgttgacaagaaaggtggggggaaagagaaggaccctgcttgaccgcgacaggtccccttgtatcctgttccctctccatcttattttctccacagtgctctagggcagctgtggagccaatgatgaaaaccacatgtttctgggcagccctgctgttgcacaatgccgccaaggggagggcaaaaaagaaagaaagaaagaaaaaaaagaaagtaagtaagaaaggaaagaaaagagctttggaattctcggcttctacagacaattcccccattgatgtgctgtgagtcacggcgggccgccaggccatcatggtttctgaatcacttccttcaagaggggctctccacttgttcccgggctgactttggccagggctggaatgcaaggagattggaccctttggagtggttctgactgccttcctctttgctggagccccagaggggaaggtggaggtgctaggcagcagggcgtaggggtctgaatggaattgaagacagcagagaagcaggttggacctgcttgtcccaattggtggacccaactcatgcccctctctctccctctgttagagaagaaaatgatgtaaaaatcccagattaaaggccaaagttttctctggtgggcactagactcagccagatccggaatttctatcctctccaccttgacatcctggctgatgtggacaaggttgacaccttttgagcagagataggttaaagttgatcccagccatgtctccaatggctcacattagggaaccttgaacggcactctcagtctcccatcttgcaatttccatctttgaggtcaaggatgttaatggcccaagaagccctcgcctgggtggtggtccttaggtgagagtctgttttaagttcttgcttaaaataagcttcactttttttcggccaagacccttaatccttgctctgggccagactctgcgtaggcaccatggatcccaagaggaaatagacatggcgccaactggacaaaagagaatgacaggtaaataagtaatgatgcaaatttatcaccaaatgcagacttggggacaaggggagctccagaaggcagccagaaatgtttgttggatggagcatttagcgccattttcctttgcccgaccaccattccttccccgccagccccttaaccccagaactttccagaagatcagtatgaatgggccctggattagagaggaagtggtctcttccctccaccaacacagggtgctgtttctcaatgaccccagctgttagggaatatgctagaatgccgccatctggtgggcacacggagccgtgtccatttcgcaactttgctgcacctggggcaagtgtcagagacgcactgacctggaagccatgccccaaagaaaccaggtttggcacggctacttatttgactgaagttacaggtgatgagcaaaaggagcgccttttaaggagtcctcctgaccacattcagctggctgtctccctttaaggaggtgaacttggaggaaaagctagtttagagcaggcaccatatcttcatcttctctatgcctctcatagcctctagcagcagatccaggaggtaatgggtgctcaatgcatggatgttcaatgggatcagttactgaatatgatcagtgagaatgatagcaagggttctttctatcttgcaccaccatatccctagcaccatgcctgactctacaaatatacattgaaccattgaataaaattagactctcggaagtaaagattctggaaacagcaaacatgatttgctggaggacagtttaggtattgcctgtattgtctagtacagcctccttcctctcagatgcatcccagggagacacagtgacttcaccaaagtcacacagccactctttagaactgggactggtgggcgggccaacttgccacctggttgcctggcagaatccaggttgcctgcccatgtatatatgagaaacaagacaggcagcaaaaaaagtatggaggaggcatttgtccagggtcacacccagtggaagagcttcccactaagaatatctgaaacaccttttcaaggactctaatactatcctgtgctcctagggtgaaaaggaacaccacctagtgcattaaataaagaggtaaagaatgtctagcaatccaaggaaaacagagccaaatgcagttactgggtgcacagaatgtgatgtgggaggtaccagtcatgtcacaggtccaggtggagctcttgtctcccaggaagagtttgtgaaatagtataacccatgttctgaagttgagctccagagtgggtgatggttacccagatggaagaagcaatctggcttacatgtaacaataaaggatctggctgtctccccagcacactcttcgtggcttcattctctctctcaattttccctctttcctgtgccacatggacctttctaacactcttctgcttagaccatcaatggctccctattgcttcttagataaaatctaaatatcttcccttatcatcaccccactccaactctttagctacatacttcatcccttcctgcttagcccttactcaccttggttacactgttaggacgcctgtccctcaagtaggttccagtcctggcttcaccacttgctctcattgtgaccttaaggaaatcacttaattccctgtgccttcatttcctcatctataaaatggagttcatgctagcatctaccagactgggctgtcgtgagaatggatttgagttcagtatgtgaagtccgaatagcgcctgtcatgtggtatgctcgcaatgtatgttagcaatcattcctgttattatcgctacatataacatgcttcctcacgcccccatcctttcacacatgttcactgtgcctgaaatgtcctttctctgccttctccctcagatggacaacagctcattcttcaagctccagctcaacgtcccttttttagcagtaggggaagttaagtgcaccctcatctttgtacacatcccgaccccatgttcaccctaaatcccattgtcaccacgaacatccttactcatcaaatgggggtgtaatagcatctgttgatcatggtacctgcctgaaatgccttatggatgggatgggcgactccacagtcatcctgtagcctgtgtaaattgcaaagccttcaatgagcgtgagagatgtgtatttttgccatcatggaagggctgttggctgtccagcttctaacctgccaaggcagggtcagcatgtccctcgctgacccaaggcccagtctccaggaggacccctgcctctcacagacaccagctcactctgcagcctgctgggccacacttgcttctctcacccatccacccgaaagcggggttgggggaagtcaaacaccagctatgagcacagggtgctgccagcacagcctacccagggatctcccacctgctcgtcaccgaccaccttcctttggtttctcctgggctctaggggtgtctgcagcccccctgccctcaccctaggctctgcctttattctccttctgcctcacttggcctgttcaccgtaagaatggagaggtctcctcccgactcccggcccaccctccttttttctctctcctccccctcagcatgctttaacgtcctcaaatccatcccagaggctttaacaaggctaccttcatccactcatcaagcactgtgtgaggcacttactctctgcagggcactgagggagattcaggatgagtaagatgcaaacactgtcctaggaagacaggaggggaaagagaagtgtttgttgaaggtgccagcacaatgccagagacttagggtggcaaggggagagagggtgaaggtcttctgacatggtccttggccattctccactggggggctgtaggtctgcactttggttgtgcctggctggcatgcattgaggaggggctggcctgatcctgtcccaagcattcagctgatgagtgacactggagcccagttcatgactgctgtgtcctttgagcatagggaaggctccggagagcacagtctgcagcccttcttaccaagccctgccttgttctcagaatgatgccacccccactctgctctgcccgggcagcctgaatgcgagtagcccctggttgaaggccatttggccctggggcaacaaccttccttggccagcacccctgtctgagtctcagctaacttctgtgtctctctcagtggcttatgggagcctctggttcccttccatgtcagacaagaagtgagggtggctcgggccgggcgcggtggctcacgcctataatcccagcactttgggaggctgaggagggtggatcacaatgtcagtagatcgagaccatcctggctaacatggtgaaaccccgtctctactaaaaatacaaaaaatcagccgggtgaggtggcaggtgcctgtagtcccagctactcaggaggctgagacaggagaatggcgtgaacccgggaggtggagctcgcagtgagccaagatcgcgccactgcactccagcctgggtgacagagcaagactccgtctcaaaaagaaaaaaaagaaaagagaagtgagggtggctcaggagggcaaatgcagagtctctcaggctgagactgatgctgagtaggtagggagggggatgcctgggaggggatctcttcccagaattccaagccagaatggggcagaagctccccacccaccttgccagctttcttctccacccaacaaggtgcccttagctaatgcttcagctcagagacctcatggacacaggggcttctcacttctcttcccctctctccctgtctccctcccacaatgccctgcagtgaaaagctttcttctttgttgtctctggtatggacgtccctacatcccgtcttcctcctacgggcattcagcctcttgctcagcctgaatagaagaggtagctgctctatccagtaaaagaaaaaacaaacaaaaaaacaaaacaacaacaacaaaaaactatgtcctgctccctctaagtcaatagcagctaaaataatttagaaattctgattttgcttaagacaagactccttttacagactcaaaaagtcctactctgaatgttaaacattgactatcgatccgctaccactctgctttgctaacacctcaaacctcaacctccccaagacaagcacatgctgggtaagtttccatccaaggagatgcaaaggagagctctttctgcatcatgtttcaaaagcactatcctgatacagcagctcatatttgttgagatttaccacgaaccaagcacttgatatacatcatgtcgcttaatcctttcaacagtctgtaaggtagattatgttatttttcccaatttatggatgagcaaactgaggcttctttagcctagggtcaagcagcaagtaagtgagagagtcagaaatggagaaatggagctcaacatgtttgactcataaccactgtgctgaaaggggacatgaggcctgccctgcagaaatttgcagaatggaaggatatacttgtgaaacagtagacggtagtattatgagccgttcaaaaccccttgctaaaggaaggacacttactggtttttgtgcatctaccacacagcaggcattcccagagaccatatcctctcattttcacaataatcctgcacccctgttttacaagtagagtgggtaactgggcttagggagattagttctccaatggtcatgaagtggtgaagctggggttttgtcttagtccagcgactcccaacctttttggcaccagggactagttttgtggaagacaatttttccactgaccagggatggggagggatggtttcaggatgactcaagcacattacatttattgtgcaccttatttctgttattattacatcacaatatgcaatgaaataattatacaactcaccctaatgtagaatcagtgggagccctgagcttgttttcctgcagctagacggtcccatctgggggtgatgggagacaatgacagatcatcagacattagattctcataagaagcatgcaacctagatcccttgcatgcatggttcacaatagggtccacgctcctatgagaatctaatgccgctactgatctaacaggaggcagagtgcgggcggtaatacgagcaatggggtataaatgggctataaatacagatgaagcttcactggctcacctgctgctcacctcctgctgtgcggcccaattcctaacaggtcacagattggtaccaaggccacagtctgtggccaaggggttggagacccctgtcttagtccattcctgctgctgtgacaaaatacctcagactgggtcatttataaagaatagaaatgtatttcatagttctggaggctgggaagtccaagttcaaggtgctaacaggttcagtgtctggtgaggacgctctgcctcaaagagggtacttcttgctctgtcaccatgcagcagaagtggcataaaagaaatgaacactgtgtcttcacatagcatgagacatggaagagccaagcagctctctgaagcctcccaaaggccccatctcttcataccatcaccttggggtttaagctacaacatataaatttggagggacacatccattcaaaccatagcagctttgagcccaggtcatgtgatttcaagtcttaatttcttccattattctatgcttgccctgtagcttaggggaaaatgcatgaggcttcctttcctgctctagaagagctgacaacagtagaagaaatgtgacatatacacaagtaactacaaaaggacatagaacatggtaaatgtcaggagagaaagggacaagcacctagaatatcaaggggtggagcctggccccagcccagagtagcagcagcaaatggctgccgaacacgtggaatggggctaggcaggcatgctgggaagcatgcatgggagacaatgacagatcatcagacattacattctcataaggagcgttcaacctagttcccttgcatgtgcagttcacagtagggttcacacttctgtgagggtctctgagctggatatggacatgaatgagatctcggtgtggagagagacagaagtacctccaagagtgacccagccagggcaaaggctctgagccacgtaggcaggggacaagctgtcccgtctgggtggcatgtaggggacaggaaaaggaccagcagaagataaggctggggccagaccacaggaggctttggaggcagagccaaggaacttgatttgggggatcacttgaggaggtcgccattgacagatttatgttttacaatcaggtatgactggagccaggctttgagaagacacatgtggcagagtgagcaggctggagttgagagtagtagtacagtccagacaagaaaaactgccaggaccaaggaactgagaaagtggagggaggggagtgggtgtcagggtgggatggaggaaatgaaacagacaaaaagggctttaggcaacctggcaggtccaggctgctctgggccgacttaccttgttgctgtgtcctctcttaactctcaggcataggcctggctggagacaccttgggcaccacaggcccccagtgtgggtactgggccctggcattatagcaggaagatcttcttctgtccctggtccaggtaagcagagaacgtgttggggtcaaggccaggcaggaactaatggtgcagtggcacgtgttcacagaacacacctacctcttacgttctgtcagccagagttcagacttcaaaaggctggaaaggaagcagggagagagaggagatacctttattgggcattcattctaatcctcagtacccaatgagaaaaggctctgtatgtggagtttaaaaattgagattcagagaagttgaaccattttctcaaagttacaaagctactaaatggctatgagaatttggacccgagtcttcctgatcccgttaactcaacacactgtcttccccagagccacttcctacctcctgacccccaacttttcacctcctgcatcttctgactggaagctggctgccatgtgtgagcaaactaaaattctcctccaaagaagcttccccaaaaatacaccatgagcctggtccctgcagcccctcccataaaggactctgggtttggctggaaatgaagccctagcatttttttcttaccttgttttctaacctccttttcatgcttttcttgtaaaccttttttgtttgtttcatttttcattggcagcacaagcctttgtttttaaaggtaaggcagacatcaacttcagaaaataactgatagggatattttagccgtgattttgccattgataaaaaattctaaagcctaaggggcatcatcttggcccatcatacctttttttttttttcttttaaggaaagggggagaaaatttgtccagtttgggaaaaacagtgatgggaaagcaatttgataactgatgattttctgagtgcttcagcctcaagaaaaccaacagctgcaacatattcgttacatggaaatcattaagtcattctgggaagaaatgacaaatgcatgtgcctgtgtatagatggtagacatgtgtttacatatggagcaaagcacccacagagggaattactttaatattgcctctaggccaagagaagaaaaaaacacgtgcaatgaaagccccattgcaagagatgattctgaacattaaattcttattgactgtgaggtttgaactgaaaacgtagggagaagtcatcttttcctcgacacctaagctcatagggatttcccttagggagaggcaattctgtggggtggagccagcctggacagggcgtcaggacctctcggttctgatctcctctctgccgctaactagggagtgaccctgaggaagtttcccctccctttgggcgtcaatttctcaaagggggtttgacaaaatggtctctgacatcacttcctctgacattctgtggatgtgcattaagtttttatagcataaattccgaggaactgaccttctgcttcatagaattgagctgctggtcccccaccccctaccagaaagtgttccctttagtaaaattagatttttatataaatctgatttgcctagttgcatataaccatttgcattcacaactttgttacctcaaacccaactccccagttgagacgatgaaagcaaaacaattagccatttccaacaaagaaactttgtttctttgttttcttccaaaaaagaaaacttttttttttccaaaaaaaaaaaaacttgcatcgcagacttaggtgtgggaaagatgcccttagcgtggaaggactgaagcatgtcatggctcgtggaacaaagaacctgctgggcctgagaacccatacgagttctgttcctgggccatggtgaaatctggccggctgttctaaattgagtgtgtgcattttggtggggactagcggggaggagatggcagaagttggttgttgatagacccaatttaattattttgatgaccctacgggtaaatacaattatcatctctgtctcaacctaagtggcagagtctggaatcaaaccagtcctcttaaattccagtgagtgtgctctgaaccatgacactctaatgcagagcctctcaactctggcactattaacgttttggataggctaattctttgttgcaggaggctagcctgtgcattctaggattagatgcatccctggcttctacccgctagatgccagtagcaattcccctcattgtgaaaaccaagaatgtctccacacattggctcatggtggaaccacactgctctaatgtcagcccaagtgaggaggaggaaagggcagccacgaggcccatatgtcaccatcccctaatgtaaatctgagggatcaacccagagatggagttggttgcagcatcagtagcagtttgggaagcagggtgtaggttaggaacatggcgaactgagatgtctaaagcatcctctgatgatggggtatcacgcgtggctgagttgatgtatatctgagcaagcatgggccatcctcagtttaaagccttttcattcattcattcattcattcaagcatgcatccaaggcttcctgacttctcactgagctggccctgggggagccagaggagcgatcatgccccacctgtgtgctccagaaacatgcatatcatggagaggggcaagaatgttagccacaccatcgaaaataacaaccctacccagaggccagctggagacctcctaactcaaggaaaattccctggcctttctcagattcttgctaatcactggtgggctcatcttcttctgaacttcctctggggcactgactcccccatggccatcaccccacacacatcaatgctggcatcaagttcagtggcttctctttctcccgccacaagcgaaaatgtctcctaccaagagcagtgtgtttagtagactcactgacctccttagtgaggtcccaagaagggagtcttatctcacaatacagagcccttgtctgtcttcttggccttctgtgctcttccatctctactcctcagacccctcacagttggccaagatctccaatttcttctccccagtccctcccacccatgaggacttggctgcagctgaccccagaccctcaagtgactgaccttctattccagtcgctaagtatgttccccacaaagactttcctctctaaggaggactggggaagcagctgttataaggtaataaaataaaattcatatcagcataagaatacttggtattgtaatatttttggccgtctctaatgctgggcaagaagctaagtgcttggcatgcattatctcatttaataagagactcagattgtcacagcgctgtacagtaaacacgcggcatagtgagtcagagcatactctctcaaattagagttccaaccctgcctctgaccagctgtgtgagcctgggctttgtagttcatatctctgggcctctgtttttctccttcatttgtgtaatgggaaagagtaggagcatattctgcttagcattattgtgaagattgaaaggaccaataaaagtgtaaagtgcagccaggtagagtggcctgccatcccagcactttgggaggctgaaatgaggggatcgcttgagcccaggagtttgagaccagccggggcaacatggtgaaactccgtctccacaaaaatgcaaaaattagccaggcatggaggtacacacctgtggtaccagctactcgggaggctgaggtggaaggattgcttgagtctgggaggcagaggttgcagtgaactgtgatcgctccactgcactccagcctgggtgatagagtgagactctgtctcaaaaagaaagagagagagagagagagggagggagggagggagggagggagggagagagagagagagagaaagaaaagtgtaaagagcttagaatagtgtctggcaattagtacatgctcaatgaatgctggccgttgtcataactgttggagaatgaatagagaaatttgagattgcgtctgtcttatgatgggataactcacagagcgggggaattgggggaagagttctatagcatgagtaagagttcacctccaggaacatctaatgctctgaattttatgaaatcaaagcctactagtcatgagccccttctcagcctcatcagctttttctcctggctttttccccactgattttctcattcccacaaggcccagtgagacacttgggaaaatattttccaaaataaatttcaagtcattatttgtcctaaaccacccgattctgtggcccagccctgtctactaatgttaccgccctgtccctatttagactgaggttttataaccaaccagcccctcaccagggcttccctgtccggccaccccctgcctgagtcatcctgtgttgtcacaattctagatttatgatgttggctcttgtggtctcaaagatgactctagatgggaccagccttgggcccagccgcgaagctagttttgttgtgttccgcctcccaccaccccattcttccgtggtgtagtaagaagagcatgttctgggagttggaacagggttgcctccaagctcagctgtttcctttctgtgtgatcttggaccaggagggctttctcaaagtctcaatttcctcattagtaaatggggatgtttgaagatgaaattaaatagactatacgaaaatgcctgtactcggtacatactaggggtcattaacatctattgtcacaattttgaaacataataaaccatcccaaagctcggcggcttaaaaaataattattcttgctctcacaggtcagatgggaattggctgctctaggcctggcgctgagtggaccagcaagctagccaggacatggctaactgcagcagtacaagagggtcatacccaaattcacaagcacattttaagccactgtttgtgtcacgtttgctaccagcccattggccaaaataagcgacatgaccaagcccagaattagggataggggaagtatactccgcctctagtggaagaaactatcaagtcacctgacaacaggtattgatacagagaggggtgaagaattaggaacgatgatacaatcaactgtaataggtggtcaggagatacttgtttcctaatttcatacactccttcacatccaggggcctctttgttttactttgtgcccatccaaactccctgcagggagaaaatgtaaaatgcacattcattggtatgagtggccaatgactgttgtgtggcacctcagagtaaaagaggtgcttcttggacaacaacaaaaatcataattgtccatcttagttgtttgctgtgagccaggctctgagctcagcgtatactctgtgtgtgtgatgtcatttaatctttcagcaacctcaagaggtagtacgttcccattttacagctaatgaaactgaggctttgagaggttaatcaacctgcccatggtcatgtagctaatatgtgccaaacagggctttacaatgccaagtctcaaatgcagatatttctaaccaatgctgtgctctttccattaaactactaagggcaggattttcactggggccaaaactttaagtccgggtttcccaaacttcaatcgttggtcacaacctttacaatttttaccatatttatgtactgtgtatactgtaattcatataattattgatatttttaagttttatcttcaataaacctattttcaaagaaactgatgactaccataaatggaaaaccagtatctcctgacaaaagaaaataaccataaaaaacacaagaacaaagcaatattattgaattcatgctggatactcttgcttgctatgggctccaagctctccaggaaagtgggaggtttgctaatattggggaggtgttgaaagagcacaggaaccaaactaagactctccttaatagagtctcaaaagctaagccaggtgtagcggctcctgtaatcccagcaatttgggaagctgaagtgtgcaggactgcttgaggccaggagtttgagaccagtctaggcaatgtggtgagacacccccccaatccctacaaaaacttttctaaaagtgtgtctgtagtctcagctacttgggagactgaagtgagaggatcacttgtgcctaggagttcaagataagcctggacaagatagtgagactccatctctaccaaaaacaaaaaaaatgtaaaaaaatattaaaaatatgtaatcccagcactttgggaggccgaggtgggcggattgcaaggtcaggagttcgagaccagcctggccaatatgatggaaccctgtctctactaagaatacaaaaattagccagatatggtggcgcgcacctgtaatcccagctactccggaggctgaggcagaagaattgcttgaacccaggaggcggaggtttcagtgagctgagatcacgccactgcactccagcctgggcaacagagcaagactccatctcaataaataaataaatagctgggaacagtggcacacatctgtagtcctagctactcaggagtctgaggcaggagggtcacttgaactcaggaggccaaggctgcagtgagccatgatcataccgctgcactccagcctgggctatagagtgagaccctgtctcaaaaaaaaaaaaagaaaaagaaaaatctcaaagctagaaaattcactgaaaaggaaataactttctcagcatatgattcagtctgttgatgctattttcaagcatcaccaaacatcatctcagatgccaccaggatctctgtccctacctcatatgcctgtagccttggaagaggagcccacagtaggctccgagaaaagaacaccaagaggccttctggagatccctgggtccctcctctgctgacccccttggatttggaactcatagacatgcagaggggcattctgggtggtgtcttccaagaccaaaggccagttttctcatgacatagaatataagtaggagaggtaaaacccagacacataaaacaggtgaccagacaagcccccaagcctttggcagttacagggacacacagacctgtattcaagctgactcaagttcaagagagtttcacttggttcccagcaaccagcgaaggcagggggcttcaggggagccagcccttgtctcttaacctgatggctttttactctccatacagaaccaaaacctcttccacaagccaaacaggtctccactcacttcagctgctccatctggaatatctcatccaaaacagaaccacagagggagagggggccttgccatttgctattcttgtatttctgcaatatctgcctccattctttccactgtttcattgtttctcagtctctgctcacaaagccagtcaaatcagaagtgcctcaatccttgactcaaacccgagaaaacccttactcatagtttgcagggcctggaaagactttctcaacatcctcctgctcccataacgctgtatttgcaatcttcttggagcacctattataacacatctgctccttctttatccctctattaccccaaaaaaagatctagcacaaagaagcgctagccggatgtttaaaactcaggtgtaaatatttatggaaactgccaacactaaataagcgaccttatgagtcaggttctccatccaccttcccagggggactcagatgcaagaaatgtaagtggatttttctaaggttcattttctattttaagcaccagcatgaacaaaagtcagtttggggttccctccccttctcctagagttgcgccagacttttggagcttgagttagttccaagacagtgggaggaaacaccaatgttattgatccaaatggcattcatggagatgtccatcactaggtgctcagctgatggtccacacaggttgctgttgagccagggatccattccatgcatctccactgctctgtgctcttcctggatgcacgggaatcttcctgctattctcatacctcagtaggcaccctttccgcggctccatccacctggacgtttcaagcagccacttccactctagggtcctgctgcttctccagtgacatagttctaccaggaagtaatgtgcaggtcccctccttgcctgaatctccttgggacttgttccttattccaaggctcacgtgccagaagtggggtacagctccccaccccaccccaacccccaaaatatccccttttgtggatttacctccacttttcccctttcccccagacagggaattcttgtctcatctcagaggtgagaagccctgctcttacataccgtatttctcccaaatctgttgtctcctatgccaagagttgttttggttttcctaagaacttgggttttggaaacaaaagcagagggcagggagcagttacgtccctttcccaaagcagtagccacagagcagcccactggctcaaatggagaagggtctcaagagaaaggacataccaggtggaaacaattaccaattaacgtttcagaaatatcatccagcctcacaagctttaaacacacacgaaagcacgtattacttgtagagtaaattattaaagcagacaagtttaagatgcaaggaggtatttttctgccattcctgggcccttagctttttttttttttcagacggagtttcgctcttgttgcccaggctggagtgcagtggtgcgatcttcgctcaccgccacctctgcctcccgggttcaagtgattctcctgcctcagcctcccaagtagctgggattacaggcatgcgccaccatgcccggctaattttgtatttgtagtagagacggggtttctccatgttggtcaggctggtctcgaactcccgacctcaggtgatctgccctcctcggcccttagctctcatttaattattgtctggctttagggaggattctgggtcccttgtccttgccttcttaattttcttaggaaaagtgttttgaaggaaggaatgtcactgtcaaaaggcacagtttcacctctgagtcctctctggattctcccctctggtgttttctctcggacctgggaacctcttctctcctcctgtgtctgccacctctcaccaccctttccccaaccacttcctgctacgacatcattctaagaactgagctgaggctggagagagctaggcagtggagggccaaaggcactgtgattccaaaaagaggtctgaaccaggttctcccccatccctcccctttcccggaacagtcagaaaaagaggagaaaagccaccaaggccacagcactgggaggccccaggcagccaccccaggaatgagggaggaggccacgggatagaggccgctgctgctcttccaaaggggatttcttcacttcctgccaggctctggtacacaaacctgtgtgtttaggagggaaaggaatgtcactgattgctccagtggtggtggaaagggaaaaacgaaaataacctgcccagcagttcagtttcctgtgcatgtgcctgcatgtgcgagcgtcagtccatccgccagcccagcacacttcctgcttgtctgggctggaaggcgtttatttgggagggttgcgtggagccagggcatgctgaaaaggcattcccagggcccctgacactcacgtggcaggacagctgccacctgccacctagaaggaggatctttatcctcagtgtgccttcagggactggtggagagcacctccctcttcctcttccccacctcatacccctcccctccactgccagcctccaaccctgaatgtacggttgactatctgcttatatgtctcgtctccctgctaaacttcaggctccccaaagggtagcaatggggtcaaattccattttgtatgtcctgcctagcacagtttctggcactcagtgggtattcagtatatgtttgtgaaactgcactctgtctcccatctccctccctgaatagttcctttctcccatcatcagtcagtcttgtcgctttttttttttttttttttttttttttttgaggcagagtctcgcttgcccaggctggagtacagtggtgagatctcggctcactacaacctccacctcctgggttcaagcgattctcctgcctcagcctccaagtagctgggattacaggtgcccagctaattttttgtatttttagtagagacgtggtttcttcatgttggccaggctggtcttgaactcctgaccttgtgatccacccgcctcggcctcccaaagtgttgggattacaggtgtgagccaccgcgcccggccccttgtctctttctttaagcacatcctctcagtaaatgctctgaactgtcctataggagaagtattgttacctccattttacaaatgagaaggctaaactcaaggtcaaattcataccaatcataaaatattagaggtttgaaatattgagatttgaacatggggtcttctgatttatttctactataactcttttttccctcctctgttcttcatttatcttttcctttatgggtctgttctgccccccccgcccccccaccatttctaatttgccctctcattattcttagagatctcttacagtgatttcaaggactctctgggcttttggcagaaggcttaagttgacccctgtggggcgagattaggtggcaacgcaaagtgtgaagataaacatccttcacatccctgctcaaatctcacccccttggtggggcgcagtggctcacgcctgtaatcccagcactttggcaggccgaggtgggtgggtcacaaggtcaggagttcaagaccagcttggccaacatggtgaaaccccatctctactaaaaatacaaaaattagccgggcatggtggcgtgcacctgtaatcccacctactcaggaggggctgaggcaggagaattgctgaatctgggaggcagaggttgtagtgagctgagatcacatcattgcactccggcctgagtgacagagtgagattccatctcaaaaaacaaaaacaaaaaacaaacaaacaaataacttcctcaaaaaaggtttccctatcacttttataagctcatctttttaagtgtaaattgtgtgcacattttataatgtccatatggatcagcatattaatacaagtataacttttaggtagatttaaaaaacaaataactcatcatatattgagatgcatcctcacctttttttgatagggggcctgatcaaaaagtttgggatagggccaagcacagtggctcaagcctgtaatcccagtatttgagaggccaaggtgggaggatcatttgagcttaggagttcgagacagcctgggcaacatagtgagacccccatctcaaaaataaaaataaggccgggtacggtggctcacgcttgtaatcccagcactttgggaggccgaggcgggcggatcacgaggtcaggagatcgagaccacggtgaaaccccatctcgactaaaaatacaaaaaattagccaggcgtggtgggggcgcctgtagtcccagctactcggagaggctgaggcaggagaatagcgtgaacccaggaggcggagcttgcagtgagccgcgattgcgccactgcactccagcctgggcgacagagcaagactccatctcaattaaaaaaataaaataaaaagataaaaaatcaaaatcaaaataaaaaagtttggggtaggacactgagtgtggcttaagtcctttcacagtcttgtgatttggattgcccttctagaaaatggttggaatccttaaccagaaacttctttattattattattttttttaaatggagtcctgctctgtcacccaaggctggagtgcagtggcatgatctcggctcactgcaacctccgtctcccaggttcaagcgattctcctgcctcagcctcccgaggagctgggattacaggcgcttgcaccacgcctggctaatttttgtatttttagtagagacagggtttccccacattgaccaggctggtctcaaactcctgacctcaggtgattcacctgccgctgcctcccaaagtgctgggatttcagatgtgacccaccgcacccgggccttaaccggaaacttaaccagcacagtgtgaggattgccagaggaaatgctctagaaatatgggagtttccatctttggaggctggggaggggcaatctgtacccctgaaaagggtttctcaaacaatgaggtcccccaatttctcaggaagcactttttcgttttcttaatatcagctttattgagatataagtcacttacaatacaatttacccactttaagtgtagtattaagtggcttttagtatattcgcagatatgtgcaaccattaccaccttcaattttagaccattttcctctccccagcgagaaacatcatactcattaagcagtcattccccttccctcctcccacaccccaacagccctaggcaatttttttttttttttttttttttgagatggagtcttgctctgtcgcccaggctggagtgcagtggcaccatctcggctcactgcaaactctgcctcccgggttcacaacattctcctgcctcagcctcccgagtagctgggactacaggcgcccgccaccacgcccagctaattttttgtatttttagtagagacagggtttcaccgtgttagccagaatggtctcgatctcctgacctcatgatccgcctgcctcagcctcccaaagtgctgggattacaggcatgaaccaccgcgcccggccccagaactcacatcttaacgtttagcttcccagggattctgaagcacgtacgagttgcagagccttgaactccagtgaggtgatgttcattctgaacacgtgagctccacggttcagatcacaagtcagaaagaggccagccctgcctgactgcctgtaatttaatcaccattgttgacgttcgtgctcaatgtattgaggtgtttctcatatatgatgatgccatgggaccacatttactcttcataatcaatctgtggggctggtttggtcacccccgttttgctgcagaggcagagacctgggcgaatgcccaggcacacccagcttaagctacgtagcaaaccagagccttctgacttgaagcccgatgcttatttataatacccctgtgactctgtttctaaatcaaagatgaatccaagtgatctgacaaatatgaatagatttttttttttccgagacagagtcttgctctgtcgcccaggctggagtgcagtgacacgatctccgctcactgcaatctctgcctcccaggttcacgccattctctcacctcagcttccggagtagctgggactacaggcgcccgccaccacgcccggctaatttttttgtatttttagtagagatggggtttcaccatgtcagccaggatggtctcgatctcctgaccttgtgacccgcccacctcggccacccaaagtgctgggattacaggcgtgagccaccgcacccggccaaatatgaatagatttatgaagactgtgaggagctggggctggagtcctgtctgcttagcccctactccaccccagtggtactcctgcagcttcttagtggaacccctagttctctgaagaacacagtttaaaaaccgctggcctaggagcttaaagtcatctctcaaggagaatttgatctaaatgagattaataatgtctcattaattcatcaaccctttctaaacagccatcttgtgccagcactttggtcgattctgagtacacaataaacaaggcacagtccctgcctccaaggagcttacaatctagcagagaggcatgggataaatgctacaatagaggttcattcctgggagtatgggcagaggaggcagccagcgtgatttgtggggtaccaaggaaggcttcctggaggaggtgaggcctcagtggagacttgaagacagtatagtccttcaccaggcagagggaggagagaaaaagcatttcagttggaggaaagcaggtgcaaaggtaaataggcaagagtggcctgtgtgtttgtggagagaacagttttgcagttctagaacatatggattgaagaaaggagtggcagcaagagcatgagactgaagaattggatcaggatcaaatgggaagaggataggactttataacatccaatagccacacaaagtgtcatccaattcagtgctaaaccacagattctgacaacagcactcatccaaggaaaagggacatggtggctcacacctgtaatccaggcactttgggaggccaaggtgggaggattccttgaggccaggagtttgagaccagcctgggaaacacagcaagaccctgcctttacaaaacaaatatttaaaagttagccagctgtggtggcacctatagtcccagctactagggagactgagatggtatatcacttgagccaggagatcgaggctgcagtgagctatgatagcaccactgagccatgatcacactactacattccatcctgggcaacagagtaagaacgtgtctcaaaaaaagaaaaggaacttaattcacaaacatgaaagaagcaaaagaggctaccgtaaccaaaacagtatggtactggtacaaaacagacacatagaccaatggaacagaatagagaactcaggaataaagctgcacacctacagccatctaatctttgacaaagttgccaaaaataagcaatggggaaaggactcccttattcactaaatgatactgggatagctggctagtcatatacagaagaatgaaactggactcctacctttcaccatgtaaaaaaattaaccaaaatgggccaggcgtggtggctcatgcctgtaatcccagcactttgggaggccgaggcgggtggatcaggaggtcaggagatcgagaccattctggctaacacggtgaaaccccgtctctactaaaaatacaaaaaaattagccggggtggtggcgggcgcctgtagtcccagctacttgggaggctgaggcaggagaatggcatgaacccaggagacggagcttgcagtgagctgagatcgcgccactgcactccagcctgggccacagagtgagactctgtctcaaaaaaaaagatttcaatgtaagacctcaaactatatgatcctagaagaaaacctaggaaacaccattctaaacacaggccttgggaaagagtttatgagtaagtcctaaaaagcaattgcaacaaaaacaaaaattgacaagtgggacctaattaaactaaagaacttctgcacagctaaataaacaatcagcagagtaaacagacaacttacagaatgggagaaaatattcacaaactatgcatctgacaaaggtctaatatgtggaatctatacagaatttaaacaattgaacaaccaaaaaaccgatagccccatttaaaaaaattgtcaaaagacattaacagatgcttctcaaaagaagacatacaagaggccaacaaacatatgaaaaactgctcatcatcactaatcatcagagaaatgcaaatcaaaaccgccatgagataccatctcacatcggtcagaatggctgttatcaaaaagtcaaaaaacaacagatgttggtgaggctgcagagaaaagggaatgtttatacactgtctgtgggaatgtaaattaattcagccactctggaaagtagtttgaaaatttctcaaagaacttaaaacagaactaccattcaacccagccattactggatatatatccaaaaggaaacaaatcattctaccaaaaagacgcatgcactcacgtgttcattgcagcactattcacagtaacaaagttatggaatcacatagacacccaccaagagtgacctggataaaggaaatgtggttcgcacacaccatggaatactatgcagccattaaaaagaacaaaatcatgtcctatgcagcaacatagatgcagctggaggcttttatcccaaggaagttaatgcagaacagtaaaccaaacaatgcatgttctcacttatgaatgggacctaacatgaagtactcacggacataaagatgacaacaatagtcactgaactactaaagggaagagggaaggaagggaaacaagggttgaaaagctaactgttgctgggcgcggtggctcatgcctgtaatcctagcactttgggaggccaaggcgggtggatcatttgaggttgggagttcgagaccagcctcgccaacatggtgaaacccccatctctactaaaaatacagaaattagctgggcatggtggcacatgcctgtaatcccagctactcaagaggctgaggcaggagagtcgcttaagccttggaagcagaagttgcagtgagctggcatcgtgccactgcactccagtctgggcgacagaatgagaccctgtctcaaaaaaaaaaaaaaaaaaaaaaaaagaaaaagaaaaaaagaaaacctaactgttgggtactatgctcagtacctgagtgacaggatcattcatatcccaacatcccagcatcatgcaatacgcccaggtaacaaagctgcacatgtgccccttgaatctaaaagacaagttgaaaaagaaaagcaaacaacaaaaccaaaaacccagggagaaggtggaaattaatgataatacctgacatatccaccacgcagactgtgtattcggcagactttaaacacattagatataataactctgttccatcctcacaacatccctatgatggtgggaccgtcatcatcctcgttttgaagttaaggaaactgaggcacagagatgttagaaaacttgctcagcctcacacagctagcaagcaggagtgtcaggatggaaaccaagcagtctggctccagacattggttctctattacaacacttcactttgcctctggtaagatttagaattgcaggcacaaccgtcttcctccctgcagggactccctgtgtagaacagaagagcattcagtaaagattcatttttgttgttgttgctgtcatttctagttcagtggttctcagactgtgcacctccacctctgcaggatgagtcaagtttatggtggaggcgggacagggtggagtggccttacttttatctgttctatatactgggacactggctataattttattttttcaaaaagaggttaattgctttaaaagaaaaaactgaaagccacctgtctaatctgaccatctcattttatagatagaggagctgaaacccagaagagttgagcgactattgcaggatcatatagcaaatgaatgtcaggactgagcctgtgtccaaatctcctgacactgctttagagagcctgtttctctttctggggctctcagatatccaaggcaaagaaaaatgaaataattcagagtgtctagatcctaggccaagttttctgcccagttccaactatactgagtgttcagccatgattatccccccaggatcaaggtcaccattactgagcctcactgattgcagatggcgagaggtcaaggtgtcaagtccatctagcaatggcccgtcatggggacagccacttttaaggtggatcttctcttttaccaatgactggtgaaggtgggaacagcagttccagcaaaatggttttgattttcttttcttttctttttttttttttttttgagatggagtctcgctttgtcgtcccggctggagtgcagtggcacaatctcggctcactgcaagctccgcctcccgggttcacgccattctcctgcctcggcttccagagtagctgggactacaggcactggccaccacgcccggctgatttttttgtgttgttagtagagacggggtttcactgtgttagccaggatggtctcaatctcctgaccttgtgatccgcctgccttggcctcccaaagtgctgggattacaggcatgagccaccacgcccggccgtggttctgattttctaacagtccttgtcagggttcttagcaggctcctcagaatgacaaatatggttcatttctttggggacaacattcaaaaatgtcagattccttctacatcgataccttaagggaaaaaatacgtatgtagagtttcaagttcaaaaaatcttgttttgttccaatgagcagctgcctaatgatttcaagcaaaggagggatcaggaggattttttctctttcttttatcattctttcttaagtctttttaaagaaaaaagttaactcagttaaaacaaaaataacgtttgggtttagtttgggagattcgggaaatttgcatggcttatttgggagtctacttagttgtctcctccatctgatttggagaacagagtcccagagagcaaccgtcaaactgcgttttctgtataacatggctctgtcattcatccagcacataccggctgagcacctgcactacaacgagtactaagccagatgccaggaaattcaccatccacagaaacccagcattgcaccagggaccttgaaagcatctgtgaaatatttgctctaatatcctagaatgtccctatttcaaatatctggccccaatgtttgcagatatgttctgatttgggttgaaataagtgaaggtagtgggttaactcagcatcagctgtgagtaaatatttccctgtatcatagtcactgggaatgctcatccacctagttcaaccaacatctactgagcttcccaaatacaggccgaatacagccccagattctgaagatggaaaataaagaagagagaagatagatacatatagaaaatagaagatagatgactgatagactagatagatggatggatggatagacagacagacagatagatagacagacagatagatagaaagattagcctacagacataccacccttaacacaccgctcttgtctgatcttggaaactaagcagggtcgggcctggttagtatttggatgggagatgtagaccgatatacaacaagcacagagttgagaacatcatgagggttctcccagtagaccggggtgtctaatcttttggcttccctgggctacattagaagaagaagaattgtctagggccacacataaaataaactaacactaatgatagctgatgagctaaaaaaaaaaaagttgcaaaaaaaatctcataatgttttaagacagtttacagatttgtgttgggccacattcaaagctgtcctgggccacacatggccggcgggccacaagttggacaagcttgcagtagacataatttctgcccagggtgggaaggcagaggtggccaagggattccggagcactgaaagggcctggaagccagcctggggaaaccaagaagggattcctggggcagaggtgatgctggagggcagtcctgaaagagaagtaatagttagatgaggaagaggacaaaaggggaacagcgtgaacaaaaaacaaggaagccatgaaacccctcgcagggagggaaccacagacacttgtatttctggaggtggtgccgagctgtctagtgattttgagttagagtgccctggtcagatatgcattttagatcttaactgagaatccttttcacggatgccgtcaacccctcattcccatatgcactatctctacgttgcctctgtgaatacaggaacatatatttgaattcagtgccacagcaagtagcagaagatgccaagaatcctgaactgatttgggtgatcatgcttctattgagtcagatgctatcgtctagtggttcggaacatagattctggtgccagactgcctgctgagtttgaatagtggctcggctgtttatcagctttgtagccacagatgagttacttaaacctctctgtgcctccagtttccttatctatacaacagggataatattggttcctacctggaaaaacagttatgagactttagtaagttattacgtatacatataaagtgatcagagcagtaccttgtaagcattcagtaaatgttagcaagtattgcttccatttttatctcttacaacttccctccaagagccctctgtcccagtggcagtcccttgatggtcctctaagtaggctgtccatttctaaaaccaagtctttgccggtgccagctccctcctaggatgcctttttttgtgccaggttgggtggctcacacctgtaatcctagcactttgggaggccgaggtagatggattgcttgagcccaggagttcaagaccagcctgggcaacatggcaaaaatccttctctacaaaaaaaagaaaaaaaaaatgagattgagaaaaacgcacctgtggtcccagctactttgggaggctgaggtaggaggcttgcttggacctgggaggtcgaggctgcagggagctgtgatcacatcactgcactccagcctaggtgacaaagcaagactctgtctcaaaatttaaaaaaagattatttttcctttccttgctccctctgcctcggaggtcaaaatctgctgtcctcggcgtaccacctgaggcccaaaggccttcccaacaactaggattcccctcttttcttaatgcctacgcacgtaggaccaaccttgttttgggggtacttcatccaatattaccttattattccacagagaaatttggtcctgggggaagggcagggggagacagtggaacatggcctatcctaggtttcaggaaccccaggttagaaccccaggggctctgccacttaactgtgtgacccgggacaagtcactgttcctcggagtctgtttgctccgctcaaaaatcaggataataaaatcaaagcagtctgatggaggtgatgggtgtgacaagtcagaaaatgaatatgaagtatttcgtaaaaataataactgatgatttagttatgactatgagtctggtgctaagtgccgtacatgacgtcaaatcccttcatctttacagcagccctatgaggcaatgtgcggttattcctcccatttggtaaatgaggaaaccaaggttcagagtggagaagtaatttgcctaacgtcatgagcctgtatgtgaaggagccgggtgagaacccatgggttgtggcttcggaatgaacacgcttgaccactatataaattctcaagtgctggccaaatgacaggctttgtgttattatccataactacccgatgaactaatggaattagaagccaaagacatccacggcggtccccgggtcttgcaaaccctgtatgcgtcacgttaatagaaaatgacagtaagaaaacacagtgaagtggcgatttccctgggtttggggttaattcttctaccagtaatacaatcaaaccttgagccaggctgagaagtaaataggaagggaaaggctaaggaggatgattgccaaacagctgttgaatgcctacagggcctttgctctgcccctagcttcctgccccaaacctttaagcaccaagctgcagattctcagtcatcaaaccttagggcaggaaggaactttggagattctctggcccatctcccattagttcacagatgaaagatcgaaggccccaaagggaaggtgtctcggccaaggtcaagggctacttcccattagtttaggatttatcaaacactgcaccactcacaaacatgtcttgtttgtggatcagccactgagaccctgaagaggaagtaatttgcccaagatcccatacaagtaaatatcagagctgggattctaaacgcccaggcaagagctctcaccgccatagcacactgcccagtggacagcagaagcccaggtccaggttgccagttcaagtctcttttcctaacattaagctgctgcctgcaatgtcctgggagattcaccaacccctcctggcagtgtatgctggaacacccagggctccacaccctgcctggtgatatgggcgcaggcccactcacatactgccaatacccctgcattgagcaatgaggcccccagtccaggaattgccacaagacctttatctgtctagggcagccactatcttccccttcagcatccctccggcgcctagtaaacccacagatcctggctcttcactctctgtcttgtttttataggaagtcaatctaagagccaaaggcaaattcctcacctcatagactatttgttccctgcctttggtgacataaaagggctctggcttgggcaatgcaggctttagagtggaggtgctggagtctgatcatgctgggttcaaataatacatcaccgcttgttgctgtattactttgggcaagttactcaccctctctggacctcaatgtcttcatctgtaaagcggaaaatcttaacagtacctacctcataggatggtgggaggattaaatgagatattgaatgtaaagcactttgatgcctggcacatagtagtttctcaataaaaggtgtaattattatactactgcaaccttaggaaagacacagcaattctaaggttgctcattttcaaaagcccagagttgtatcaggtggtttcctaaggtccttcctgctttaaagatctgtgaaattacttgactccaggtgaatttatttttctttccttcttgtccctgaaggaactttaggatttgcagacttcagccttaagcagagccatacagaggatgtgctcaatgatttaagagcctaaagagacaagcgtttgaaaatacgcacaaaaacccaacatctcaaacatcatctggcctctgcaggtttttctgggttttttttttttttttgcttgtttcgttttgagatggagtttcgctcttgtcacccaggctggagtgcagtggcatgatcttggctcactgcaacctctgcctcccaggttcaagcaattcttctgcctcagcctcccgagtagctgggattacaggcgcatgccaccacgcccagttaatttttgtatttttagtagagacagggtttctccatgttgtccaagctggtctcggaactcctgacctcaggtgatccgcccgcctcggcctcccaaattgctgggattacaggcgtgagccaccacacccggccctctgcaggtatttttaaacatccctctggctgaggttagcattagggttggaatccgagttgctgttaaattcagagccaaggtcagctttgagaggctcagcagtgggatgtgctagatatactggtgttttcaggtcaaacacctgtatttggcttctcatagaacagtagggaacacacctgtagcctgtgaaggggccaggacaaaaggatttgatgtttatcttgacagcagtgaacacccactgaagcattttaagcaagaggaagtcctaaggggaaacttgccgcagagatggaaatggcctatgtcttgattaagtgttggtcacatagctgtgcacgtatataaacatttattgatctgtactctttaaaagtattcattttactgtttgtaacgtgcacatcagttttttaaaagtgtgccccagctaataagaggcagagccgagatacaaattcagaaaggaccagatcagggcaggcaagtgagacagggttatgcaaatgtagggttggatcctatcttcattaaaatattagtattttgctcatcatgaatttatttacattgatattcatttacttaaatatcacaataataaggccaggaacagtgggacatacgtgtagcctcagctatttggaaggctgaggcaggaggatcactttaacccaacctgggtaacatggcaagaccccatctctaaaaatacatacatacggccgggtgtggtggcttaggcctgtaatcccagcactctgggaggccgaggggggcagatcatgaggtcaagagatggagatcatcttggccaacatggtgaaaccccgtctctactaaaaatacaaaaattagctgggcatggtggtgggcgccggtagtcccagctacttgggaggctgaggcaggagaattgcttgaacccaggaggccgaggttgcagtgagccgagatcgcgccaccgtactctagcctggcaacagagcgagactccgtctcaaaaaaaaaaaaaaatacatacctatataaaataacattaaaatatttattttgatttatgagtttgcaggcaccttctcagatttttatttaattttcatctcatttcattttcatttttatttaattttcaggtctcaccctccttaccctagtcctggccctgatcatccagctctgttcccctccagggtacatgctcttaaccaccccactatgtggcctctcccagtcaagggcaccatcaggattcaaagagctttgaaggaggtgacttatactgggagctggacgagaaggaagattgcaaagaggctcccaggggatggctctggcaaaatacaaagaaaaaagtttataaagcgtttaaataaacctgtgaaagacaagaaagatagtaagagaaaaaggaggtgtttggacccaggaagccaatccctgcccaccaacctctcgtccacaccgtgccgcctgcctgagaaagcctgggctggctgtcccagggctgacccggccagcctgctcttgcaagcctctttcatcattaggttcaactgctcaatgcaaacattttgatgaagatttttgtatataacaaggatagcaaatgattctttgcattacgtagtggttaaagtttgcaaacactttcccatatgttacccagatggcatctgggcctctctccttgcctcacagatctagatgtgattttcttggactttcattcatttcacaatctcctagtatatttatgcaaattcctagaggatggggaagcctctgttcctacctcgagggctgctctgttgctatcactgacccagatcccacgctcaaatccaaagcgatttctgagtgggatggatttcaccaaatatttggggagcacacacgacagggtcagagcagaaggggaggagcttcacctttcacctctcaggctccgagctcataaacctgcccagcttgcctggagagctccaggttctctttctatcaggcggagcaattctacctgcccaggtctaggagccctcctgggtctaagtccctccctaaagagcccaacagggcacctgggagaccacagcctcttccttcagagaaaaggcccccacttttcagttacaacgagggaaattgaaagcacaccacaggaagcatgaccagcggccagcacagcttacagggggaacagcccggcatcttccagcttgtaactaaagatttgagtgaggttttttttttttttagacgaagtctcgctcttgtgccccaggctggagtgcgatggcatgatctcagctcactgcaacctctgcctcctaggttcaagcagttctcctgcctcagcctccggagtagctgggattataggcatgagccaccacgcccggccaaatttaaatgacttttaacctctctgtctcattttattgtcagaggaattgtgggagtcccctgagagctcttcttccaatctctctggcccagcctctttggggctgcactttgtcagcaccagcttgggaatgtagagaaatccccaggcaggagcaggtaatccagctgctgttcccaccagtcccagatgtccttccagggcctcttcctcctcatctcccctcacttccagtaatggtcttcaatataccttgtgaaagaagaattcaaacttgtaaattaaatgagggcactacatggaagcttctagaaacactaacatcaagagcaaggggaaaagcaaaaggactcattggcccctctctgtggagccttttggaactgtatcttgcctgcccacactcttctggtagccgagagcagggctgagggtgtgcaggctccctggacccctggtaaaaacattcctctggccgggtgcggtggctcacacctgtaatccccacactttgggatttggcgggcggatcacgaggtcaggagatcgagaccatcctagctaacacggtgaaaccccgtctctactaaaaatacaaaaaattagctgggcgtggtggcatgtgcctgtagtcccagctactcgggaggctgaggccggagaatcacttgaacccgggaggcggagcttgcagtgagccgagatggtgccactgcactccagcctgggcgacagagtgagactctgtctcaaaacaaaaacaaaaacaaaaacaaacaaaaaaaatgctcctctgtgtttgtacaggtggagcttcttcaaggagggatgggtgtgtacacaagcctgcatatgtgtgtgtgtgtgttcagtctggatctttctataagtatgggggtcttggagtttccgagcatgtctctgtgtgtgtctgggtgtctggatgtctatgcatgaaagcttcatactcctacatgtgtgtatgattgcacttgcccatccatgtgtgtggatgtccctctgtggttaggtttgggaggtgtctctgtgtatcaaagtctcagcttctgggtgtgtccctgcccaggtagatgtgtgtctgcatccctgggtgccagagaaagatggaagtacagatgtgtggtgtgacctgccgtgagtgtgcgtcagggtgtgtaggtgtgcataagtgtagagggacagcagagcattagggctcacagaagctgcagcatacgtacacactatctttgcaaagcaagtcatctgttttcctggttttgtttctttcctccccatggactctggcccctccttgaaaacaaagggagcttaaaaaacgcagcccttcctgtgttcccaaatgttcagaatgctgtggtgcacttgaaccgtgccagctcggatgcccagccctgccgctgttgcaggaagttacccgcccgccgcactgccaccccccacttacacaacgaccccgggagggtgggtgggagggaaggaggaaccgcacagctcgctacccctcgacgccccagccagtggcaggccctccatgggaactgagactctgtgtgggggcataagagcatcatctgggggcttcctccaaagctgggggtgcagggagacaacacctttacatggaaattattgccaaccaaccaggtgtccagggacctcattttccattttacgaggtcagttctaggtagaagtcaacattttcatcgtttcaacacacattcaccaaatacctactacatgatagacgctgtggaagataaaacgacagctttgtcaccctaggattggtgcccgcacctccacactcggggcacccagtgtcctccataacataagggggttaaactgggtagcaccaaagcctcttccacatcagaaattctgtgattcttttgtggcaagttcatgagtctgtgctcccacacttctccctgctccaccattccccggttggggcaggtcaacagagtccccatctttctcagctctgcccaagtgctcattcctttcccgccttccttcctcccctctgaaaaacctactctcggtccttgtttactcaaagctgtaaattcctaatgaactcttctctctttgtctacacttgaacaggttccctgccttactctaaccccactttctaccaggacgatcagagccctcccagaaatgaccgcagcccatctttgccaccttaggtcccacatcatccctaacatctcagcacacattgttgtcaggtttgggaggtgtacagaagtctcagcttctgagtgtgcccctgcccagagagatgcgtgtgtgtccctgggtgcagaggagggtggcaggaaagatgtgtggtgtgtcctgcctgtgagtgctggccaagctgtgttgcacaagaggcaccctcagcacagtctcctcccaagcccagcctcttctcaagccattccctctgcctactgggaacaccctttcctccctctacccccaaccatttcctttcacggtcatttcaaggtccatctcaaacacctcctccttccttaagcttttcctgattcctccttccttaagcctttcctgattcctccttccccacccagtagacgtgagctctgtctgatttgaaacctttcctgtgatgcagaatatttggccttgacttacggttatcgatatctttatctgttgtgcacaagaagacttagatccttaagactaagcatccaaaaatgtgtcttgctcttgcttgaatcctcacatggcgtcaacattgcaggtgctcagtaagcatctgcacaactcagtccaaagctcagccatggaatgtcaggagttgggtagcctggttggagatcatggcactgtcaggggaagaggtgggaagagcagaaggaaggagtcttggaagtcacagccaggtggtcaaccaatgactgtccctgtgataagcctgagaccccaaacatctcccttatccaaaatggcctgaatgtgtgaagaaagaagaaggatgctaaagtggtctatttattccgtctggaccacaacttttccaagaaacaaaaagcaaggccgtgtcatgtactgagataactctgggctggggatggcaaacttgggtgccttcaggccagcaaaggaccaaagccagctgggagaaaggggtggttggtgacaaactagagcatctgtcccatttatagggagctggtcttgcctgcagaaacgtggcacatggatggctggatctaaccattgttccaaaaagccccatatccacagttttgtatgaaatccctcactttctaagtgtgggcaatctattccattagaaagaaaaatcaacaacactgggtggtcccagtgaaatccgtccacattcagcctgtgggctgccagactgaggttcctacctaggtgcatgccaggttatggagtgacatgactgtgacgggctccctgctgaagctaattctaaaatccacccaactagagaaagtgctgggtatgccaataaaccaaccctgggcatagaaaggcagcgggcaagtgataggagaaggtttagaatgtcttcatggtctctgaagccaggatctttgtgtgccttgagaatcatgacctagagggtaggcagaaggcttaggtcagtcaccagcttatttgacttgagcaagtgacatcctctttctgagctgcagagtctccttgtacaattagcgggcaggactagaatacccctgagatgcctttcagcctctggcaaggaaatgctaaccggtgactgtgcaaggaatgggtcccaccgtggcaggagagaattcctgttggcagggcccagacctgggaactttagatgtggaccttgcctctttccacatggcagtgccttccagcaggtgcccagcgaccaaaggcccagcccaagttctcacagctccactccgatcctggagtcatcgccgaaatctttatccatgggtgtggtgcagggcaccaacaatcagagtactgttggacaggtccctacaggtgttagatggtaggagttatggagaggtggcccaggggagaagccagtacagctaaggtggcaggaagtcttcccggtaaatgactaccaatgagatgaaagtatttcaatagcctgacaatgggtatgaccgggcaggtgtgtatccaccgaccatcagttcagccctcctcagaatgctgctcatcctggggactgcaaggcagacccagatgctggcaacaggtttgaaagtgaccccccacccagcctctggggacttccccagcaagcccaattcactccagagcccccaacccaggcctccctgggcattggcagagaacaggcaccgttccaaaccctgacttcatgctgaccaccaaatccccaagccagggagggagcgatgatgtcactgtccccatgtttcagaaaagcaataaccggactcggaagaggatcagttttcaaggcagaagtccaaacagttgatcttggcaagggcctccgaggattgcctcatagaaggagagggctggcatgcttgtgagcatcgtttgttatgagctgggaggcagcggtgtccttggactcaggagaaccttggggaccctgtcaagatggagaatgtcgaatctgaaacaaatgggcattggtgtcctcgattcccgtcagaaccctcttttatggtgggaggggacacctcggcactcacagagaagcgtttttccgacagagttcagccaccccaccctggacccaagtcccctcttattattagaaaaatgccatcagtttcctcaatttgaataagtcctatgaagatggagttttgttcaccactgtatccacaacatctcatacagagttaaagaaatcaataaatattggctgaatgaatggcaaggagaggaatggagtgggaagtggcacgtctggattccagggatccaggagcatatccaggtttgccagctaggcctgcaggccaggcagggcaggcaggttggggttatgggaagaccgccattgattgctggaagtgcacaatacatattttcaaaaacttggccaggcatagtggctcatacctgtaatcccagtgctttgggaggccgagatgggaggatcacttgagctcaggggttcaaggccagcctgagcaacataatgagaccccatcactacaaaaaataaaacataaaatagtagccagctgtgatggcatgcatctgtagtcccttggcctactacggagaccaaggcaggaggatcacttgagcccaggagtttaagactgaagtgagtaatgatcatgccccagctgtccagcctgaacaacagagtgagatcttgtctccattgaaaaaaaaactatgacaaaaaaaaaagcaaaaactatcctttgacaatctgtgacaactttctctccctggggttcacaatctcactttcatgctccttccattaaagtctgatcccttttttaaatagctgtttggctaatctgttgtggtagacactgttgaaaaggccccactttcggaaaatgtgttcaggaggaacaagtctccctcgcccctccctcccctaaactacacttctgctgtgctctcaaatgagctcagtcacatctctgtccctgagcatgtcatgtcccctccctgggcttcagtttccccttctacataaaacacaagctaaactagaaacatcctgtgtccttaacttgtaggaagagtgtctcagccccctttaagaaaacgaagcttgaagcctctccctgcaaaaatccaattcctcactagtacagagaaacttttttttttttttttttttgcatccgatttctggagatccacagcccctttgcagctcaacaagggaacccagggtcagagtcttttggacttgctaatctggaagcccctcccagctctgactttctggaatgttaaccgaagtgtggctgtgagaaaacacattccagctgctctcctctgaggccagcgctgggcctccccctcagctgcccctcaggaaggaagcagccctgggcttcactaatggccccaaattcagcccccagtttcctcaagacccaggtcccaaatcaataaaggtaggctccatggaaatgaggcaggatgcagaaggaaatccaggcagctcgacctcaaaggaatttccttttccttgcctctccttccagttctgtctttcaagagtttgatagaggtgggaacggggatttgagaattttcttttcaactgaggcccagaggaggaggtggagatgggccacaagatagagaggtcagggttggggagacagggcagcggacagtgatgaatgtgggtggggcctttgtgcattctccaggacaaagtggacttttccagtcggctggttttcgaaagctatttacgaagctggactaatccagcccagctgtgcggactgtaagcaaacagggccttttgtggggttcagattccccacccctagcctgtacttacagagctcactccacccttcctgtaggggaggaaatgaggtgcccaggtcaagcagaagagttatatcaggagttatacctatctgtcaccatcctcagccccacctctggggacccagcaaggctcacctgggcattgggatggacacatagatctgagtcaggaggcctgctcttccacttcttagctgggtgaacgtgagtgagtctcttaatttctctgagcctcagttttcccctctgtgaaatggccatattacctaacttcgaaatgctgcaggcagcgcttaacagaggagattccataatgtctttctccctctctctgaaatagagattagcacatagggagaccttgggtgaggtaggtaaaaggcaccccctgtaagggaaatttgggaaaggcagcactcgcttcaggccgagaagcagttcccagcaccaggtgcattgcttggcaagatctgccttttctcacccccaagcccagggctcctgtgcagaccagcacccacacagcacatgtaaacagcagtcacaaaatccaagctgtcctgcccaccctccatctgagatggtttttcttttagagccccagtctttcagtgaatcattatcccctctaaaatgcctaataaggggtaaaattggagcatacgttcctggttcattcctgaagtcactggggtgatgagatcatgaagtcacaggtcagcgaggcccctaaaatggaaaaaaaaaaaaaaaaggcaaaagttaccaggaccagctttacctggccctcagcgtggttctagcctgcctgaccctcctaaagctgcagtaccatcatttaacacaagtggcccagcaaagggagacttccctgactggagctgctctcctggtgagcccaagggagcatggagggatctggtgtaaatgtcttacatggtcatgtgctcttgctccagaacccttctgcattagcagtccacaccaggagtctctagctgttgaccaacttcagccatcaaaagtgttttgttggtcaggtgcggtggctcacacctgtaatcccaacactttgggagaccgaggtgggtggatcatgaggtcaggagttcgagaccagcctggccaatatggtgaaaccctgtctctactaaaaatacaaaacttagctggacttggtggcgcgtgcctgtagtcccagctactcgggaggctgaggcagaagaatcccttgaacccgggaggcggaggttgcagtgagccgagatagtgccattgcactccatcctgggcaacagagtgagattccgtttaaaaaaaaaaaagagtgatttgggttgtgaagcttcttaaaacaatttgaactcaagtttgaaaattaggtaagttcatatccaaaaatgcaggcttccgggttctcttgaaaattgagaagatctggcaatttggggccctctttcttttaagacaaccattgacccactgaaaccaggtatatgctccttattttgccccagtccccaccactccaggttgttcccccatactgaggctgctggttggttggccttatcgttaggagaaaagaaaatatgtcttatttaccttgtctataccaaaagtgaagaaacaaaaggcaaactgagaggattcaaggaaaatggaagccacaagatttccctgtggaagtagagaaatatgcctttcgtgattcatatatgtattaaaaaaaaagtttttggagtacactggctctcttcactcaaagcccctgaaggcattcacttttgacaccatattctaaacctttcttttgtaaagaaccatggcattttcaagctagaggcaatcttagaagtttgaaattttttccaaccagatttaagatctttaaggtttatgtatcggttagctattggtgtgtaacaaaccacccaaaaactcaatggcttaaaataataagaatgtattattgctcacaaatctatgagtcagctaagtggcacttctagtctcagctggtcttattcatccattggtggtcagttgtggtcatgtcggtagctctgatcttggctgggttctctcctgtgtttggaggtcagctggctgtaagccagtcctggctgttctcatctgagatgagtaggcactcttccacgtattctctcatcttctagccaactaacccaggctagttcacaaaatgattacggggtcccagagagagctgaaacatgcaatgtctctggggacctaggcagaactgggacacttctgctgcactgccttggccaaagaaagtctcaaggccagcccagattcaaagggtgggaaaacagatgccttctcttggtggaaggaactgcatagtcatgttgtaaaggtcatggacacaggaaagtcagtaattgatactatcagtgcaatcaacctaacatgagttgggactgtgtctgatgctatgggagcctctattttccaaaccaaaatttgagatttaagggctcatagtgtaacacagtatttcaaatgggtttgtcctagaccctccagaatgaatgttcacatttattcctccacatcactctagcacagtctgacccagtgacctccactgttgattatctgacccaattcaaaacctggtatttcagaacaggggtggaactcctatgtacattttgggatcaaaggctggtatttattagcaggctatgaactttataggatttcaggtctatgtgccatttaaattaatcacttttattttacaaatgaataaattaaaatccagtggtaaagcgacttagccacgatcatatggttaggtaggccagtgctgtcggacctcaacgtgttcatgaatcacctaagcatgctgtgaaaatgcagaatctgagcagccggtctggggtggggcctgagagtctgcatttctaacaagagcccaggtgatgctgatgctgctggccctgcaaccaaatgctcaatattaaggctctggacctcacagattctatagagaggaggtcacaggtagaaacacctgcatttagagtcctctctattattttgcagtccttcagcttagacccattttaccagtgggtaaactgagcttcacaaagaaagtgttggcattggatctactccctgaggttttacagaagggggcccaaggtcctccatcaccaggcaactcctagagagctgagcttaaggagctgtggcccactttgaactttcagctgttcaaggtaggggcttcctttcctgctgagaccttgggctgtgggccatcttttcacttgttgcggactcagctcatgatgttgtcccaggggtctctaagtcccagggcctgagattgtctggttagtgatttaggagcttggcagcctctcttgttctattatgcagcctctgaacattccgtccaaaggccttctggcacgccacacattttcagaatgaaaggggggaaaatgaacattgcccttgctcatttgcctaatttaaaagcatctagaagctttttttagaagggggaaagaaacaccatccatctgaaatggaggaagcacctcatcaaggagccaagagagatgtggagacataagtttcgagggctgacacattcatagacaaaccttgtgcccggtttgtttgttcccatccactttcagcttggaaaccactgcctttttggaagctctcgtgctgggaggaaattgctttttcctaaggggagacctgaaccctcctcgccccactcaggcatcagtttcctacaatttcacacgagctcagtttggctcccgaacatttattgaggggctactctacgactctgtgtcaggcactgtgctggatctgtccgttcgatcatcaaagatttagtggttagggagagccctgtgctatacatttccgtattcacttaacagtggtttattaccaggcgtcatgccaggctccggggataagaagggactgagataggcgtgatgtggctacacctagtctagccagagagagagtcactaagtgatccttattgatgtattgcaataaggaattacttattgtgataagtaatcacaatagagtgcctactactaaggcagatagaagaggtcttgctccagaaacagcatagaggagaaggcaggtcgcccacctagactcgcagctgacaagctctcctcaagcctcgggcagggtcctctccctgaccccaacccctcctctccctaaccctgcctccctcacacacaccccttccatcttccaggcaccagccagagaagagttctttcttaaatgagaatctaatggtgtcattcccctactaaaaattctttactgggcttcccactatttgcaggattaagtccaaacttctcagaatagtttacgaggctttttacaatttggctccaaatctacctttcagccctgggtcccaccccgcttccccatcattcatccttctctctccctatactgaatatcctgagctccacgggatgactcagaacaaggggctctctctctttaaaaaaaaaaaaagaaaaaaaaagatgtgtcatggaaatgttcaaatgtaagcaaatgcagagtcagtgatgtgaggcgcctccgtattcccattgcccagttccaggacgtgcccaatctcatcacctccacgtccccacccatccccgctccaaaccccacactggattattttaaagccaatccaagacaccatgtcctttcatctgaaaatacttcagcatgtatttctgacagatgaggagggtccttctttttttgttgaggctccaagtttgttgggggcagaataactgaatttgtggtacagctttaatgtgcacgtttaacaagccaatgtttttaacacacacccacatccatacacacacggcgtagtgattgtatgtctgccctcatttggagagaccattgaggaatctctatttgaggcccttcttaaacgtgaagccttggccagcccttccctcccgcagcgccttccattgaccttccatccctgtggttggccctgtttcctgaatcctccaaccactttcacacctttgggccttgtgtcctttgtggccacttctgcctggaacgtcctttcctctgttgggcacactcctgcatgaccagcaaagcccagtgcaaatttcccctatgcactgtccatgatacctcttccaacaacctcctgtcctccacaggtcatcactcactcttctttgcttctatagcattttttcttcgtaattctcctgaatgttgatatttctgagttgaaatcatttgcttacagatctgctgcccccaccagcctgggaacccttcgagggtagggtctgggtcctttctgtgtcccccagagaggcgatctggtccccaagcatggattctggcttcagccttgcctggacaagctattgaattgagtctcagtggtcttgtttgtgaactagggatgctattatactcagcactatgacaggcctctcgtgtggattcagtgccctgtgtctgtgcggctactgtggcccgactgccacaaggagacactgaacaattgtgaccttcatcaccaggtgtcagcaatgactcctccctcaaaggggcccctcagccagagacatgtccgtccttagcataaggccctagtcgtgtttgggccctggtcgttttcccctctgtcagagaccctggaagtttcctggctggtcctgggccactgagcctgcagtaaaggaccatggaccagctcgccacctcgaggctcctgctgcccctcacctcctgccccccacctcctgcccccatgcaggagagcaggccctgcgaactctgcacccttccctgggggcttctacacggaaactcagtgctgtcactccggctcctggctgggtccaggggaatgcccctctctcctcgcagcttgcagggaactcctggcatcctgcattccctgggaacttcaggtgtctaggaaggctccgtctgccaggccagttgtgacctagggaggatcttgcagcttggctttcagccaatccattcccacacgttcactcacagaagttagggagactccgcccccattgcattccctccactttgcagctgagaagctgtccctgtcgtacctggatgccctttctcccaggaagacctcctctggcccagccgtgctgtgaacgagccccaaaacagccctcctcttcccaaatctctactccctgcagacaggtgggaaaaagcggcctgtgttattctctctgagcactgctgtgatgtttcacacactagggtgggtttaaaactgcttcatggccagcctcttagaacaagtatgattcccttattagagcgtgctatccctcaaagcccactccctaaactgagagcagtggcgttcccaccttgtgacttttcccacctcctccagaatgtggcagagctggatggagccgagccctgccacttactgcgaccctgtgcccctgttgttccctccctgactccatttctccatctgtagttttctttctttttttctttttttttttttttttttagatgaagtcttgctctgacgcccaggccggagtgcagtgacacaacctcagctcactgcaacctccgcctcctggtttaagggattctcatgcctcagtctcccaagtagctgggattacaggcgcctgccaccatgcccagctaatttttgtatttttagtagagaccggctttcaccatgttggccaggctggtttcgaactcctgacctcaggtgatccacccacctcagcggtggatcccaaagtctgggattcttcccatggctgggattacaggcatgagccactcgcacccggcctcccatctgtagctttcaaagagtcattgcgaggatcaaaggagttaaacgcacatcagcacttagcagagtgtcaccactgtcggctcccaaccacggtgggggtaattttttactttccaattattcttccccattggcagtatttttttttttttggaacatttgtctgaaatttgcagaataaaaggtcccttggagtcaggggctgtttccatggggccagcacagtatgtgcttcataaagttttttttccagtgcagaagactggggatggaacaaaactacttctggattccgaggagggggccccgctcttgagttttaaggcttgggtttcacagcttcatttgacaagcttgaacctcagtttccttatttataaagttgaggtaatgccttcggccttttgtatatcattaataatagctacaaatgcagaatgaagtggagattgaaggatgatgactagaaatgggacctgcccacagtctctgcttcccaggcctcagtttcctcctttgtgtgatgaaggagctctgctgctctgggtgacctgtgagtccccacctccccaccactggtcagacagggttcatccccctgtccactcaaggggagaccccaatatagtgtaatgaagaaaactgggggtcttggcagctgcaataaccctcaagggaccatcaaatccctccactgtgtccatacagagctgcctgaccccaggcccaggaaggagctggagtgacccttgtccatctctctctttgggctcagagtcagtatctcagggcagccttccctgttacccacacacatccatcggctgcagatacatggcacaccggtagcccattaaacccctgccagcctctaccacggaagcccagattcctcctgtcagatgtcactttggaaagctgagagcaatggagtgagacagaacagcagttgcaggaatgcagttgggttaacaacaataataccaacagccagcactccctgtatgcccagctgagtgctttgtgccggttaattcatttaaaccctgagacaacctctgtggagcatcctacttttagccctattcacaaatgcagaacttgaagcacagagaagtgaagcaacttgcccaaggacacacagctcagcagtggtagggctgagattcaagcgcaggtggtctggcttcaaagactgtagttttaagtgctcactgtgttttgcagcctcttccgtaggtggaaggaagggtgaaggagaagctaaagaaagcatggtgcaccctaggcagggctgaaaaacaacaaagacaccaagagagcaccagtcacctggaatggcagagggtttgatacaggggagtttttgatactctaaaagtagttcagtcaatacgtaataatgataatggtaacaacaacagcacctgacgtttacagagctctcggcaatctgtgtgcctacattcattcaatgaatcccatcaacgaatccttacagaggacctactccatgttgggcaaccaatgaacaaaatgaatgctatccttgccctcacggaactcaaataaacgtggaaataaatatatcagggcaaacccaactttagctttccttgttggcaggattaactccaggtctcaaagcttcccctctgaatggcttcaaagttagccatggcataagagctcttgaaaaaatgaaggtcattttcagaagggaggaggcaatggccttgcaaggaggagggagggctagagataattctctctcctaccctgctgctggtaccctgtaccaatatttatttattcatatttatttatttgttatttatttactgtattatattaattcattctcacattgttataaagaactacctgagactgggtactttatttaaaaaattaattaaaattttttaatttattaaaaaaaaaggaggcttaattgagtcacagttccacaggctgtacaggaggcatggctggggaggcctcaggaaacttacaatcatggtaggagggtgaaggggaagcaggcacatttgcacatggcagcaggagagagagaagaggaagtgccacacacttttaaaccatcagttctcgtgagaactcccttactatcgcaagaacagcaagggagaaatctgcccccatgatccgatcacctgccaccaggtccctcctcccaacattgggaaatataattcaacatgagatttgggtgaggacacagagccaaaccatatcatttatttatttatttatttatttaggacacagggtctcactttgtcacccaggctggagttcagtggtgcagctgctcactgcagcctccaattcctgggctcaagtgatcatcccacctcagcctcccaagtggctgggactacaggcatgtgccaccatgcctggctaatttttttttcttttatagagacaaggtcttactatgttgccttggctggtctttaacttttggccttaagcgatcctcctgccttgacctcccaaaatgttgggatttcaggcgtgagccaccatgcgtggcctccagtatttctctatacttttttctttagcccctaaagcgaaactatttttctactcgcaacacttctgacactaaatatgtgggttttccataccaagtgattatccagttctctgtggataccaactgagtgtcctgcaattgaattcaattctgacactaactatctggagttagcatagatcctaccggttaagggctcagtcccacaagactgtcccccacttcagaagccagttgcaaatttgggtgcccatggtacccacacttttgtctgactggttggagttggagttggagttcgcataagtccctgctcatatttgataatttgctataactgctcacataattcaggagacactttacttatatttattggtttattataagagatgtgagaaaggatataaagaacagtcagatgaagaggaacatagggcaaaatccagaagggtcccaaggacaggagcttctatcaccatggagttggggcacaccaccctcctagcacacggaggttttcagcaacccggaagctctccagttctgtagttgagggatttttatggaagcctcatcacataggcatgaagaattattagttcaatctctatcccatctctccttcccagaggatgaagggtgggactgaaagattcaagcctcaatctggtgaccagcccccatcctgaagctatccaggagcccaccaagagtggcctcattagaacaaaagatgctcccagcacccctgtcactcaggaaattacaaggcttttaggagctctgtctcaggaactggaagcacagactaaatgcatgtttcttatcacgtcacagcatcctgaacattcttccttcttagcccttctctttatcaccttgctcatgggatgacaaagtaagaataagccagaagcagagatcttgctcaccccaataattgtacaaaagatctagctcagctgggtgcggtggctcaagcctgtaatcgcagcactttgggaggccgaggcgggcagatcacgaggtcaggagttcgagaccagcctggccaacatagtgaatccccacctctactaaaagtacaaaaattagccaggcatggtggtgcgtgactgtaatcccagctactcgggggactgaggcaggagaatcatctgaatctgggaggcagaggttgcagtgagccgagatggtgccattgcactccagcctgggcaacagggcgagactccatcccccccacaaaaaaaaaaaaaaaaaaaaacaaaaaaaaaactctagctgaagccctctgctctcaaatggccaaagatacaacagtggatgagacggaaaaggtttcacacaggatgcaagaccctgcaagctagtgttggttcacttgtgaaaaccctccttcttcccaaatgttaaaaattcatgagctgcccagttaggtatagaaatcacttctgatccagggcgttgccaaagtattacccatattcttgagatttcctagacattcatttgtcttcatggtctgcaatcactggaaatacatatccaggtcattccaaaatataattaaacgtcagacaccatccatacaacagaatactgtgtggcaataaaaagaatgaagcactgataaatgttacaacatggatgaaccttcaaaacaaagtggctggacgcagtggctcatgcctataatcccagcactttgggaggctgatgtggttgtatcacctgagatcgagagttcgagaccagcctgaccaacatggagaaaacccgtctctactaaaaatacaaaattagccaggcgtggtggcatgcgcctgtaatcccacctacttgggaggctgaggcaggagaattgcttgacatctggagggggaggttgcggtgagccaagattgcgtgattgcacttcagcctgggcaacaagagcaaaacgttgtctcaaaacaaaacaaaacaaaacaaaacaaaacaaaaacacacatacaaagtgaaggaaactagtcacaaaaggccacatattgtttgagtccatgtgtctgaaatgtccagaatagggaaatctgtagagacagaaagtagagcattggtcatcagaggctggaaggggctccagggaaatggggaaggactggtactatgtaccgagtttctttttgagtgataaaaacgttctaaacataggtagtgttgatggctgcacaactctgtgaataacctacaagcactgaactgtacatttctttttttggggggggcagggggacagaatcttgatctgttgcccaggctggagtgcagcggtgcaatcttggctcactgcaacctctgcctcccgggttcaagcgattctcctgcctcagcctcccgagtagctgagattacaggcacccaccaccacacccagctaatttttgtatttttagtagagacggggtttcaccatattgcccaggctggtctcaagctcctgaccttgtcatctgcctgcctcggcctcccaaagtgctgggattacaggcgtgagccaccacacctggtctgaattgtacattcttttatgactagtttccttcacatttctaaaagggtgaattttatggtatgtgaattgtatctcaataaagttgtaaaataacagctgtaaacagtttaaaaattcgggcaccatctctgcagctatagtgggtcagatttcactgaattacattaaaaggttatgcaagatttacaggataaaaaccaggcagaggtcaagtgcagtggctcacacctgtaatcccagtactttgagaggctgaggtgggagggttgctttaggctaggagtttgagtccagcctgggcaacaaagcgagaccctgtctcctccaaaaacacttttatttatttttttttaattagctgggcatggtggcacacgcttgtagtcccagttactggagaggctgaggcagaaggattacttgagtacaggagtttgagattacagtgagctacgaccacgccactgtactccagcctgggcaacagagaaagaccctgtctcttaaaaaaaaaaaaaaaacaccaggcaggatgtcatcactagagtttaagtatatttctgcacaggtaaataaatacatagaatcattatttatataaggaatatcagacaaattcattattcaatgtaatgataactttattttattttatttatttatttattcatttattgagacagagtctcactctgtcgcccaggctggagtagtggctccatctccgctcaccgaaagctccgcctcccggattcacgccattctcctccctcagcctcccgagtaactgggactacaggcacctgcaaccacgtccagctaattttttgtatttttagtagagacggggtttcaccatgttagccaggatggtctcgatctcctgacctcgtgatccacccgcctcggcctcccaaagtgctgggattacaggtgtgagccaccaggcctggcccaatttaataactttaaaaataaattcaaagcagatatttttacaataaatagtacaaaaaggaaaactttaaaaaaaagaagaagaaaaaaagagcaatggctatcactgtatcaagtactaatttgaaggagggggagttgtactgattttaactgcgtatcagtttaaattatccccaaagagtttctggctaggatccagatacctataacatgtattttacatgaaaactcaaatcttcacaacaacgtcgattttgggtgtgcttattcccatttataggtaaagcagctgagactggaaaggctaagaaacttgccaaggatatccccataggaactgatgctaatgatatttaaacgcaagtctgcctggcttcaaagcctatcttctctcttccagctaatttcatggcactgcacaaatagtttctctgaaccagatgaaatgcctttgcctacagccccaagcaaacagtatttcttctatgcaataccaagacaacagtacttttaaacaaaagtttacatttatctttaatcttaagacattaaatgtgtgaacatcaactgaagcaaagaaatgtggacactgaagtaattgttattcaactattttctgaagtaactaagaagaacagtaattcccatattaaggatcatctgacatgggctgggcatggtggctcacacctgtaatcccaacactttgggaagccgaagcgggcggatcatttgacgtcaggagttcgagaccactctggccaacatggcaaaaccccacctctactaaaaatacaaaaaaattagctgggcgtggtggcacgtgcctgtaatcccagctactcaggaggctgaggtgggggaatcgcttgaacccaggaggcggaggttgcagtgagccgagatcacaccactgcactccagcctgggtgacagacagagcgagactccatctcaagaataaatactttttttaaaagggtcatctgacttggaaaggggtgcttttccccatctacagatgcagctggaacaagactgtcaaaaaaagtaaattatagcacaagcccagagggtctgtgatcccgcagctgcgtgtatccatgtggctcagggtggtcttcgcttccccgtcatttaggatcattcagaccctccccagagccacagtttgctggagatgttgtctgcatggtgagtgtcacccaggaggatcctcatgggagactgaacctgttctatgctataaacatcacacaggcaagaacaagaaaagcagacaaatattgccatcctatcagtttgtttatttttgactattccgtttctcagggaaacaggaaatgtaagataatggaatatttgttttttggtagggcagatttcgtttcatttttctgaatatgctaccggtattttcccaagacagacttaaggtggaaggaggtgatgcagggagttcagaggtgggattagaaggccagagagctcgaggctgggcagggagaccacagacctcactctgcaaacatctcctgggccctcctgtgtgcctgaccagggtcaggacaggtataaggatgaagaaggcaggcaggatctctatcttgggcacctgggcgggtggtggcagcgttgactgaggttggggtacaagaagagaagagaacatttttgatgggaattcatgcagttgtttggaaatgttgagttgcaggttctgcagcagcacctggcggccgggatcaggaggcaggtctgtcattcaggagaggcctgagggttcaatgttgagcagccacagacactgccccaccgcttctcttggagtcagacattcctcaacaatcacacagatccatttgaaatggctaagaaggaagaacagatgagcagactgtgacataggcagggagatgcaagccagctgcttggggaggtgatgttggagctgacttctgaagcatgcagacatggacacaggaaggggaacatcacacataggggcctgttgtggggtggggggaggcggggagggacagcattaggagatatacctaatgttaaatgacgagttaatgggtgcagcacaccaacatggcacatgtatacatatgtaacaaacctgcacgttgtgcacatgtaccctaaaacttaaagtataataaaaataaataaataaataattattttttaaataaatacttatttaaaaattaaaaaaataaaaaataaaaaataaagagttggctgaatgaagaggagcagagagggacttcgctgcaggcaataaaaacagcatatgcaaagcccctgtggccagaggggacagcactagtatactagtatccaggctggggagaaagccactgagcctgggccagagaggctgatgggggagtgtgggtaagatgggtttggagcagaaggcaggggtcagaccacacagagccccgtaagccgtgaagttttgtcttaacatatttgcgtttccacatttcactcctctaaatggcatttggtagatttgtcacaacatggcagaattacagaagagttgcaaaggtcatcttgtctgtgctcctcctcctgacaggagtgtctctatgtgccgtgcttaaaattccaaggagagtctgtcagatgctacacagcaaggttaagctttatgaagcagccgtgggagtgctcctgtgctttctgttgaatgagtctgttttaaatgtctaccacaaaccccatttccgggctgccccatttctgtcaaaggcttcgtaacgcgctccctgctcacaacctgggcctcaggcttccttccccttcccttcccttcctgcttccaaggaataacagatcagcctttgacatcccatggcccccacttgctgccgtgcccctgagatcatagatgtggaggagatgagagcaagggcagactgccgtcctactccaggccagccaggccctgggcatcctctaagttcatttgtgcctctccactagcaacaaccatccagtgaccaactcctcagtgaccaaaatctattataatgtccattcctcccatcaatctggtgggattcaagtgatcttcctatttggggcatgaggaaactgagtcacagagtggtcggtgacttacccaagggctcacaactgtaaatgtgggagccagaagtgaactggcatccttctacccatgtccatgctgctgccaccttgccctgccctgcccagtgatgactgcagccagtcttgtcctaacaggtctgctggcctccacccacgtgctccagttctgggtgcaggggaagcactggatgatcatagttgtccagaggcggcaccatgcaggagggagcaggggcgggtggctctggctgaatcctagctcttccactttcttgctgagtgatcttaggccaaaaacttcacctctctttgcctttatttccatgtatgtaaaatggaataaagataggagctacctcacagaagaagtatcaagaggcttacgtggggcgatatatgtaaagtgcttagccccatgcctggtacacactaagggctcaagagatatgagctgttgtttccacagcctccagagaactcttcctaaagcctgctctacaggtgtctaccccactgcatccaaaccctcgacggctgcctggtagccatgaaacacagttcaaactcctacctctggtgccaggcccttcccaagcttgccattcctgatctgtccgccctaattctggctgcatccccaacaaaccttccactcgaatcaccacattcctcctgactctgcctgttcgcatatgacttctcccgcttgttgtgggagacttcgtctaatacgcattcaacaaacgcgcttactgtctgccgggccttgtggagagtctagagacgcagtggtaaacaaaacaagcaaagttcctgtcctcagaccacctatggggagtggagaaacagacagttaaaaaaaagatgaatgtataattctttttttttttttttttttctgagatggagtctcgctctatcgcccaggctggtgtgcagtggcgccatctcggctcactgcaagctccacctcccgggttcacaccattctcccgcctcagcctcccgagtagctgggactacaggcacccgccaccacgcccggctaatttttttgcatttttagtagagagtgggtttcaccgtgttagccaggatggtctcgatctcctgacctcgtcatctgcccgcctcagcctcccaaagtgctgggattacaggcgtgagccaccgcgcccagtcatgaatgtataattctaaatggtgtctagagctaggaaaagagaactctcagagtgagatagagaagataacaggaagtgcctacgggagaccagtggcccgggagggcttttcagggacagaatttcagcggagacatgagtatgagacgggactggcctagaaaagagtgtgagggagggtatctcagcggagacatgagtatgagacgggattggcctagaaaagagtgtgagggagggtatctcagggaaacagggaacagcttacgcaaagaccgtggctggagggagtgcggcacattcagtaaagaactgaaaggtcagtaggctgtaactgggagttaggggttgggctgaggaggaggagggagacacatgagatgaaacagaagacatgggggagagctggatcaggcagagccttggaggcaggaaatggaggccagctcctcctggaagtcttcccagacttcagtccttgatttcttcctccagattcttctcgatcttgattttcccatcgcttacgtaggaccagactctgactatttaaatcttcagagtcaagaacataggaggagttgcctcctttggtgggaggctgtccgggccactctaaagtcctgtttctctgactctgtggattgaggatgcggctgtgactaggctgacctgggcttccactcccatctctaatcctcccaagggaacacccagcataggcactgggctaccccgagtattttggtttctttgggttcttttgaataaagcccttatctgggtggggatctctgttttccaaaatcggtctgccccttctgacaggatgtcaggcctcttacgccactgggcagtgctgcactctggagtgcccagggcatgtgagcgggacagggagcctgtgagaggctgatgcagacctcggcatccccaggggaactaaataaagctattgttgggaagggaagagagaaaatagccggcaagatgttttttgtcctctgtgacctgtctgtgtttggggaggggctggcatgttgcaaaggggtagaagtgggaatggccttcgacacccatttgaacagcttgggaagtggggtggccacagggcagcagcaccgtcttcactgtctggcttcgggcaaagggctgtgttttctttctttcttttttttttttttctttttttttgagacggagtctcggagtctcgctctgtcgcccaggctggagtgcagtggcacgatctcggctcactgaaagctccacctcctggattgacgccattcccctgcctcagcctccctagtagctgggactacaggtgcccgccaccatacctggctatttttttttttttttgtatttttagtagagatgggatttcaccatgttagccaggatggtctccatctcctgaccttgtgatccgcccgccttggcctgccaaagtgctgggattacaggcatgagccaccgcgcccggccagcgctgtgttttgttatctataacatgggggagggaaaggatgctaccatccataaagtgcctggtcccgttcctggcccttcttacatgacaataaatacagtcacttttagcctggaggtaatatggtggctgattcaccccgtatgcaatgccatggcatccggtttcatttcttgagctctaacaactgactttagaaatagaagcctgggcgacagagcgagactccatctcaaaaaaaaaaaaaagaatgtctccaaattctgctggttctccctttgaaaatctcctggactggcctggaggaattaaaacactagctcataaggacatgtgtacaaagatgtttaatgaagtctcgtttatagtagcagagagagaatgaataacacaaatgtctattaataggaaaccagtgcacgtgtacatgtgtagacggtgcagctattattaaaactatcaggattggctgggcgcggtagctgacgcctgtaatctcagcactttgggaggccgaggcaagcggatcacaaggtcaggagatgaagaccatcctggccaacatggtgaaaccccgtctctactaaaaatacaaaaattagctgggcatggtggctcgtgcctgtaatcccagctactcaggaggctgaggcaggagaatcgcttgaaccagggagttggaggttgcagtgagctgagatcgtgtcactacactccagcctggcaacagagcaagactctgtctccaaaaacaaacaaacaaacaaacaaaacaaaacaaaacaaaaaactatcgggatagaactatctttattgacatgggaggaggggtgtatacagtgtgacgttaagagataagagctattttcaaaaatacaaacatcagcctcagccatatccgtgcatacgtgtttgcaaagattgcacgtggtgagggatgggcaggaatacaccccagacacactggggaggtgagattagttacctggtctggagaaggggagtggggaaagatagaagaaaataaaaacatctgtagcaaaaataagaaaacacttatggtataatattaagtgagaagatagatgcaaaattctacctctaatattgttgtaaagtatcctgggggttttattggacatataaaaattataaggtaatgtggaccaatgcaaacactgatttggttagacaatgagattgtagacaatttttgtcttgaatttctctggtcattttaatactattatttcaataaagaagtgtcacaaaaaaaaaaaaagaaaagaaaagaaaagctctgggagtgctcccactccctctaccatttcttcccagtccaggcccaaccagtggcatttactgtctttagaatgaattccaaactggcccctggcccttcagtcaccactagcacaaatccatcctgcccacagctggcaggtcgctccccggttccagaactatcctgcttccccactgtccatccaagcaacctgaactcccctctttggtttcaaaggcccccaataatctggccccaaattacctcttctgtgtccccagcactagcccggagtcttgccagcccatacgtggttctaaaaagattgctgtttcccacaagtcaaagtaaaaaatggcaaaggaggctgggcgcagtggctcacgcctgtaatcccagcactttgggaggccaaggcgggtggatcacgaggtcaggagatccagaccattctggctaacacggtgaaaccccgtctctactaaaaatacaaaatattagccgggcgtggtggcgggcgcctgtagtcccagctactccggaggctgaggcaggagaatggcgtgaacccaggaggcagagcttgcagtgagctgagatcgcaccactgcactccagcctgggcgacagagcaagactccatctcagaaaaaaaaaaagaaagaaaaaaaaaggcaaaggaaaatttcccctagtatcaggaaaatccattgctttggatgaattctgaaatgttttctgtgaaatatcttacttaaacattctcagattttgctagattgactttctgtgttctctaaatacagatacagcacctactccacaatttctagcaatgaacacattcctccaatttcatttaagaaccctggagaaggacatgccgttcaaatatacaattctgttcagcaatcacctgcaaaatagatttattgcagatcaaatcatattaagtggccgggaggggtggctcacgcctgttatcccagaactttggcaggccgaggtgggtggattacctgaggtcaggagttcgggaccagcctggccaacatagtgaaacccggtctctactgaaaatacaaaaattagccaggcatggtggcacagcctgtaataccagctactcggaagtctgaggcaggagaattgcttgagcccaggagacagaggttgcagtgagccgagattgtgccactgcactccagcctggcagacagagcaagactctgtctcaaaaaaaaaaaatcatattaagttgcataaaataaatccttccttcctatgggtctttgtttattagagctcatgaagaatctaaacatgccccacgggaagaccgtggtggtctgcaccattcacccttgggggaactctgtgccttctatccatccacccacaacctactcatccttcagaaccctggtcagagcctcatttcctctggagcaggggtcccccacctctgggccacagaccagtacaggtccatggcctgttagaaacagagctgcacagcagaaggtgagccgtgggtaagtgagtgaggcttcatctgtatttacagccactctgcatcactcgcacgaccgcctgagccccatctcctgtcagatcagaggcagcattagattctcataggagtactaaccctgtcgtgaattgcgcattcgaggaatgtaggttgccctctcgttatgtaaatctaatgcctgatgatctgtcactgtctcccatcacccccagatgggactgtctagttgcaagaaaacaagctcagggctcccactaatcctacattatggtgagttgtgtaattatttcatcatgtattacaaggtaataataatagaaataaaatgcacaataaatgcaatgctctggaatcatcctaaaaccatcccctcatccccctctagttcgtgtaaaaattctcttccacaaaactggtccctggtgccaaaaatgttgggctctgctctggagacttgcacatgaccgcgacgtaccccacagcttcctgccatgctgcctcactctgctctttcattgtacagcccatgggtccaagcagataataaatcctctgagggcagaaatcttgtctcaacctttggtgtgccccaaccagcacaagacacataactagccacatagttctcattcagtcgtgcccacgcaattgatttgatattattttattgatcactatcatggggggtggggagcatttattacaccccagatatgcatatgattcccagaaaagtgtgccttgatggagagagtgcttgatggagagtcaagacacataaacttgacttccggcgcagtggctcacacctgtaatcccagcactttgggaggctgaggcgggcggatcacgaggtcaggagatcgagaccatcctggctaacacagtgaaaccccatctgtactaaaaatacaaaaaattagccgggcatggtggcgggcacctgtagtcccagctactcgggaggctgaggcaggagaatggtgtgaacccgggaggcggagcttgcactgagccgagatcgcaccactgcactccagcctgagcgacaaagcgagactctgcctcaaaaaaaaaaaaaaagtacatcaggggcttcagctgtctaagcagtgttttatttcttaagcaagctgatgtctgtaatattgctctttaaggctttttccatatgtgaaatatttcataattattattaagttaacaagtaataaccaccaggagtattctcattacataatattaagtggaaagagcaagaaccaagactggatatccactatactcccaattttgtaaaaacagaacaaatcaagggaaaacctcaatacagattttttttaaaagagcagcagataataaaccaaaactgttagcagtctgaggatgatttttattgacgtctttatacttaaggtaattgatatatatatcaatcaataaggtaactgatgaggttctttcaattaatcttatcatattttgcaaagtttttatagtgagtacttattgcttttggaatcaaaatcaaatgttgctgtttttttaacatgtatgtattcaccatagacaccagggtatggtaaattttagcctgaaatcaaggaaaaaaaaaactatggctgggcgcagtggtttccggggctggaatcctagcactttgggaggctgaggcaggcggatcacctgaggtcaggagttcaaaatcagcctgaccaacatagcgaaaccccgtctctactaaaaatacaaaaattagccaggcatggtggcacatgcctgtaattcctgctatttgggaggctgaggcaggagaatcgcttgaacccaggaggcagagattacagtgggccaagatcgtgccactgcacttcagcctgagcgaaagagtgagactctgtctcaaaaaaaatattatttaaagtctactgcaggccactcttgtgctagactaaaagggaactgttcaactcaagctgggagtctgacagacccaagttcaagtcccagctccaccccttcccagcaactcacttgagtctcgattttcttatctgtaaaatggtgattaaaatactttccctggttgccttctaaggccagtgtgggggtaaaatgagatgagggccacagaatggctttgtgatgcacaggcggccttctgcagaggctcagcagctactacaggacagaccaggcaagagacatcaagagggcaaggctgcgttccttcggtgcccacagtgtaagaggacagacagtgctgtccatggacagccgaggagaaggggtcaggatggcccccagttgggaatggtccacatggaaggaagttatgttattagtacataactaggagggataacctttgccctcacgcaatgcaaaatgttcttctagaaatcaagaaaacaccctcaaaaaacacatgaacaacatgaaagggggaaagcaaagctcaggcctgagtcctggcttcctagctccctggttaagtgatggtgtgtgtggggaagtatacagtctttccagcccaactgtctcacttgtgtcagagggagaagcatgcatgcctcctaggtcttgctgaggggcctgattgaaggacagattcagtatcgagcaccttccctggatcaggccgtgttctaggagctgggggtgcagcagggaaccaacccagcaaggctgctgtcctcaagtgtggcttcctaagggaggtgacgcagagcagtcgctcagcacggagcctatgtggtacagtcgataaacgcttgtgccagaggcagacatggccgctattattaagcagcctcgtatggtggcctggggaggcttaagggaagtagtgaaagttttcaggtggttgaagtgttatttgaaagaataatgggccaggcgcggtggctcacacctgtaaccccagcacttcaggaggcagaggcaggcggatcccctgaggtcaggagttcaagaccagcctggccaacatggtgaaaccccatctctactagaaatacaaaaattagccaggcatggtggcaggcatctgtaatcccagctacttgggaggctgaggcaggagaatcacttgaaccctggaggcaaaggttgcagtgagctgagatcgtgccattgcactccagcctgggcaacaagagcaagacttgtcccaaaaaaaaaaaaaaaaaaaaaaaaaaaaagagaataatgtaagacaggagtatgccaggaataattaagcttccattcactgagtgccacacatgtaataactcaatcctcacagcaaccccgtgggatactattattatcgtcttcatttgacaaatgaagaaactgaggcatgggtcaatgcaataacttgcctgaagttgcacagcggtaaagccaagattggaaaccagttggtttgtcccactccattgtctctgcagattgatgggtgccccagacaagctggtcttaagagctcagagcttcctttggaagccaaaagcactgacattgagggtgtttgggccatggctgggtgaccatctgtcgaagcattcttgtggggattcccgaccatatgaaatgaatggatctttctatggaacaagcagcacccagagccttggtggcaatgctctgagatgttaagagtgacttcttcttgtctctttcaggtcacagccccacacttcccggtggtagtcaagctgggacatgcccacgctggaatgggaaaggtatgagaaacagcccttccactcacagtggacacacccagagattccccagactacctgttcctctctccctctgtcacccatcaaccccttagcacaggcacccagaacagagtgttagaaagaatccatagtacatctccttcccctcccagcccaccttcctcagagctcctggtgcacagaacatctctccagttcagtccatccttgccaaatcctacctggaattgctaactaatcattctctatgattgcgactgaagagaaagagatgtagagcattttattgagcgtaattattttgtaaggggttgctgtcatcatctccacagccatgttgtaagcccatgtcttactcatctctttattagtccattctcacgctgctctaaagaaatacctggaactgggtaattttaaagaaaagaggtttaatggctgtggctccacaggctgtatgggaagcatggctggggaggcctcaggaaactttcaactgtgtcagaaggcgaaagggaagcaggcctgtcttacatgcctggagcaggaggaagagagagaaaggggaggtgctacacactttattttgtttttgagacagagcctcgctctgtcacccaggctggtgtgcagtagcgtgatctcggctcactacagcctccacctcccaggttaaagtgattatcatgcctcagcctcccaagtaggtgggactgcaggtgtgtgccataatacctggctaatttttgtatttttagtaaagactgggtttcaccatgttggccaggctggtctcaaactcctgacctcaagtgatccacccgtcatggcctcccacagtgttgggattataggcgtgagccaccacacctggccaaagtgctacacacttttaaacaaccagatctcgtgagaactcactcactattacaagaacagcaaggagaaaatctgcccccatgatccaatcacctcccaccaggcccctcttccaacatgggggattacagtttgacatgagatttgggtggggacccaaatgcaaaccatatcaatcactgtagggctgctgacacctagaaaatggcaaacacatctggcttcatggaagaagcccccagagtcagttaactgcaaaagtcaataatataatatatctcacacagtcacaaataacatcctgacaaactatattggtcagactccttcagttgcaagtgtcaaaatgttcaagatattaggatgtctgagatagttcttggtaggaatctaccaagatcagcagagctggatccaggagttcaaatgaaatagagcttgatctccctctttatctcttggctctgttcatctctacttggcattttcttcagacagtcaaaatggctgtgagccacccaacctggtccctaagctcaccatccccaaaggataaagaccctctttttgtccagcacctctgtatctaatcccatggaaccttgcttggatcaatgtacttggcctcaacaatgggatgtagagatagtttaacaccagtcaaaccatgtgcatcagagtcccacaggaaagggggcactgggggtctcccacagtttgcctctcaagcctctggttcagaaacaagtgggaacatgtgggtctcagtacctgccactcacattggaggggacttgagcccagacacaatgcccaacatagtgggtcctagataaagtacagctggagttaaacaatgtgaggccaagtagacacctttctttgagtaggcccacccagacgtgaataattcttcacctcacatctatagttttccctaccctgttataccttctgtatggctaaactccattcccttcaggcagcctaaaaaggaatgggtcagctgggcgtggtggctcacgcctataatcccagaactttgggaggccaaagagggtggatcacctgaggttcggagttagagaccagcctgaccaacctggagaaaccccgtctctactaaaaatacaaaaattagccaggcgtggttgcgcatgcctgtaattccagctacttggaaagctgcggcaggagaatcgctggaacctgggaggtggaggttgcggttagccgagatcacgccattgcactccagcctgggcaacaagagtgaaattcagtccaaaaaaaaaaaagaaaagaaaaatcaaaacaaaaggaatgggtcaggcagatcagggcatgacccatagcttggacatcttcataaacttgggtgagttaccatctaacttctcttggtttcctcatcagtcaaatgataattctaataactatcttttaaaaagagtcctcccttcagagtatatctctctagaaagtacacaccttgagggcaggaagttctgcctggttttccactgctgtatcccagagccctgagtggcacccggtacacaggaggccccctgccccacttcttgcttgggtggatgaatgaacgaacccctctttaaccatcatcctatgtctgccccccaattcccttgtctcccactgcctcttccatccttgcatatggctccagccccctccactccactaaagctgtcctctcagtggtctccaatgatcgtctgttgctaattcagcaggcacttttctgtccttattggaatccacctctctctatcatttacagtggctggccatccttctgtcccaaactctccttatagtggcctctggtgcatgcttctctcctggctttcctcctctctgtctcttgccactccttcttgttctccttcaagaacttttcttcctgcatcatccctaaccgtggctattccatctgcacacgatccctgagtgctcttgtcagctacctcagcttcagctgccatctgcatgccaacagactcccgagtcacctttttccttcccagagcatcaggctcttatatccagttatgtcctctacatctctactttgtctcccatggaaacctcagagcctaaacatcccagaccaggctcagcatcttcccagacaccctcacctccctccttctcctcctcctctgcttcctcctgtgacctccatctctgcagcaggaaccaccagtcatttagttgcctcaaaacagaaacctgggagtcatctccccctcctccatgtccaaatggtctccaagtcttgtcaattgccccttgttaatgtttctctgacctgtatctttctctccacccatttccactatcttggacagctctggtaaagtcaaagcattcccaagaattaaactctgtgcttaaagcttaaaataatccccaacaggacataaaaaggaaataaagagatgagaaactcaggtccagaagggcctcccaaaacatggaaaggagggtgcactccaaggattaaaaaaaaaaaaaatgacacagacgagaataaactgaggtttgcaaaaatgctgagatcaagggaaaaggacttttctccttatgtttggaatgagaaaacttgcagtaacagtctcgaccaagttgatgaagcaaaggatgtcatattcatagctgagagagagaaaaacaaagctggtacctgtggtacgtttaccttctcttgggagtgaagattgtcctcctggagacaagcaaagagaacgttcctagaagaaagctggtaaggaggctgtcaatgagctcagtgttgcttgaaatctacccaggcccccatggatgcaattgctggcctatcccaaattatacttcactcctttgttcttttatacttgtggtgcctactctatgctgagaattggaaaatcaataggacccagtccctgtcctcaaggaattggagagatagtcgtgtaaatatgcataatgtgttgttgggggcctggtagaaggctgtgcagagggtatgaggcttagagaaaagaacttaattctacctagttggaaaaggcatcctaggagaattgaggcttgatttagaaagaaaagtgcatggcctttgttggcactggtgattaagagcatgcccaggaaaggagaaaattcaactagtaagaggaaacctggcatcaggggaactgcatgtgattgggtgtgcctggagatttaagaaatcctaaaaaataaaaaagactagaagacaagagatggaacaattacccccttgtattaaaacaaaaaaatagtggacatcatgagaaacagaaatcaaaatatggtgaaactctgtgccattttgggagtgcttagacagtggtccgtattcatggggataccataagttcgttagaagtcagtcaggttagacaagtggttgggaggaaaatgatctgcccccgggcaggaggcatttggatgtgtctggaggcaattttatttgttataacctggggacagtgagggggtagtactgatatttaccaggtagaagccagggatgctgctagacatccacagtacataagacagcttcccacgacaaaaaattgtactgccccaaaatgtcaatacagtcgatcccacttgtctgctggggatacattccaagacccccagtggattcctgaaaccactgatagttctgaatcattattcctctacatacctatgataaagtttaatttataaattaggcacagtgcccttgaactttgggggccactatgaagtagaataacacttacttgaacattccgtgataatggatccagtaactgagatggctcctaagtggctaacgggtgggtggcatatacagcatggacgtgctggacgcagtgatgattcacgtcctgggcagaatggagctgggtggtgcaagatttcatcacgctactcaggatggtgtgcacttcaaaacctaggaattgtttatttctggaattttccatttaatgtatctggaccgcagttgaccgtgggtaaccaaaaccacagataagaagggactactggagtatcaaggttgagaaacattgcacaaaactaacttcatttccttttttggagattttaccagactagaaaccagaggaagccgtggtgataatagagttcaacatgtttcaaagcatgttctgaagaattgtaattactcaggatgccaaaatctatttttgtcatataggtttggaaaactctgcattaaagtaagcttttagcgcagaacttcttagagtcataaatttggtcatatacattgttggggtacaagaacggaaaagtaagtagaaattcccagatttatctaaccccagaaaacttttgccattttctattgagatggttgtccttttattaatttgtaagaacatctcacattcgaaaaccattaatgctttgtcatactttggaactattttctccttttgacaatgacatgtttgccttattattcagtttttagcaatttttaagtttttttttttaaatgcagccatatgtctccgtctttggaagcagattgttattacggtggctaagggtgtttatttgaatctaggtcacaccacctaatagttgtgagaccttagataagttgcctcgtccactttagtttcttctcatgtaaaatgaacatagtaataattgtatgagcttcgtaagctggttgtgaggattaagagacattatatatgtcaagcacatagctcagtgcctgaaacaagtgggcacaccagaaatatggcccgtcattattaagaatgttcagacctgttctgggcacccaaaatccaacctaagtcagtaggggagatatgattaaatagcatcatatgtcacataatttatttcacttggctacaagtttagtatgactcagatgaggactgggttgccaaaagctctaatcaacaaatgccaaataaatagatgaaaataggctcaactttattagtcatcagggaaatgcaaattgaaaccacaatgagttgctactttatagccacgagaatagccaaaattaaaaagattaataatgctaagtgttggtgagaacatggaacagttggaacagacacacagaaagtacatattttttgtaaaagcataaatttgtacaaccacttcggaatatagcttgatattgtctactaagctgatcgcacaggagttattttaggtatacctgacctaaatacatgcatgtgtgaccaaagcacatgattatgctagatttgtttataattgctggaaattcatatgtccatttaatagaatagataaatcaattgtagtatattcatataaatggaatattttcagcaataaaaattaatgaactacaactacatatagcaacttgaatgaatctcacaaacacaccatttagtgaaataagtcagaaacaaaagattgcctatttctatagttccatttatataaaatttaaaaaccaggaaaacttaactatagcattaactcatatacatatttaggtgatagaacttctaagaaaagcaagagattatcaccataaaagtcagaatagaagttatcttcggagaggacggaagggatagtcatggagatgaggcagaagtgggcaaagttctagttcttgatttagggggtggttatgtgggtatttgctttgtgatagttcattgagttgttgttttttgtttttgcccttcttcatagttgtgctatatttcaaaataagattttaaaaatgtaattcactcttaggatctatgaatggaaagatgatacccagaacaaaaacaagagccctgcacctagctagccagtccacagccagaagattctggtgttctgggctgcaccaattttgggtgtttgaaagggatagtgacaaattaatgtatggaagaatgaaccaagtagtggatggatgaggcatataccccagaagaactagagagagtgtgaccaacaacatcttcagaaacatggaggattatcatgggaagatagattagaccgattctacataacatctagtgggcatagttgggacccaatcagtgttatcagtcctgtggaaagagcaactttctaacaatcagaggcacatcttactggactgcccccttaggtaagaggttctcatcactggacagttggagcaaagatgagagagttaggaaacttattgagagtttcaagagattaagtattatgtgaggttcttagcctgagatatttgcaccccctgaaatagagacaaacttgcatgtgtgtttatgtgtggatgtgacatgagcattttgggggaaaggggtccataacttccttcagcttctcattagtcgcctgaccagcccaattaagacaccatggaggtgacccttacattatcctccaatgatgagattctgtggtattaaccaatgttatgagcagtccattggaaggaattgctcaatatcatgttgatgcagagcaggcaagccccacaactgggacttagcctgggaaggttcttggctttgttcgggaaagaattcaagagcaagagagcaaaccagtggtaggagaaaacagctttattgagtcagcagtgttacagctccgtgactcctcctgcagagcagggctaccccacaggcagtgtgttgagaataggagctcggggcagtgtttcagtcatatttatacccattttaattacatgcaaattaagaggcgggctattcagaaatttctagaaaaggggtggatctgtcaatgccatggaaagaggcagtaacttctgagttactggcaagggtaaactggcatgtactggtgagcatgtcttatggagaggtgcttttgcctcttccctggttcagccagtcatcagtctggtctggagtaaagacctgcctcccacctcagcgtttccatcgtagaattagaaattaagctcaaggccaaccgctggtatagtgtcagggtaaagcttacagaatctggagtcaaggttcctggtttaaatctggatttactatttactgtttgtgtgtccttgggcaagttgcttaacttttctctgtgcttcaatttcctcatctctaacacagggacaataatctccctcccagggttgtaatgatgatagaataaattaatccaggcttaggaaggtggttggttcagtgaatgggagctttaaaaacacactacaaatataccctgttatgttgattacttaaccatttatctcagctgagatgaaataagcagttacaatagacaaaaaggggagaggaattggattaaattctgagtaaattcttaaaataaggaaattcagcatccccaggagaggctgcagtcacaaatgaaccccactctaggagtcatcttatccttatttcatagattcaggctctcagggcttgactcccagcacctcacttagaagataagaacttgcggcccagagaggacaagggccttgcccaaggccacacagcaagggagcatctccagtaacagaacaggaagggaaagaaaggcctttgaaatcgttcagccccattccattctttagagatgagaagagtagtaataatacgagcaataataatcacaataataaaagccagtgttctgtagagcttactctgtgcaggcactgttctcagtgctatatgtatatatgtagtgcagtcctcataacaaccctatgaggtggatactattagaacttccattttacagatcaggaaactgaggcacaagcagtaaatggtggagtggggcacaaccctcaggcagtctggctgagctcaggggagtgacatggtaccagatatcctaacactccgccatgcaggtacagggtttgttgtccttctaagaagaccctagagtaatgatgacaggttgggaaacctctgcagacacccctgtctgttccgggtgatgagagggccgctcctccaggcgatgtttccagcagcgccagcatcttgcacacgctggcttagccaggttcgctgccgtcatcagctccaagtgacctggactcggatcccttctcttaggctgactcactttatgagctttccgggcctggtcggcctttggagtgggagtcagtggcccagtaacacggtgatgaagagggagtattagaaaatgagcaaatagaggaatggatcccaggggaatagttaagaaatcaaaaggttccccgcaactgggagacagccagagaggagagtctctctgtgtttcacagatcagcagaagtccagccaaaagtgagcagagaagaggcacccacccacgaggtgttcagggggagggagttctgggacccagctaaaccgtgagggaccctcccccccaacacccactgccctccctctcaatcccacctccctccctatgtcctctctcacctacctgccactcccttttgatggccactggcctcctttattctctgcttctctctctctttttttttttttttttttttgagataagagctttgctctgtcacccaggctggagtgcagtggtgtgatctcggctcactgcaacctctgcctcccaggttcaagcgattctcctgcctcagcctcctgagtagctgggactacagacgcaggccaccatgcccagctaatttttgtatttttagtagagatggggtttcaccatgttggccagaatggtcttaatctcctgacctcgtgatccacctgcctcagcctcccaaagtgctgggattacaggcgtgagccaccgctcccggcgtattctctgcttctcttgagcacagtgggccctcgggaggggatacatcagtcccctacaccttaatgaagactttaggcactgtgctccctttacacatcctctgcaatgaagttgtcctctccacaaatgcaacatacacagtccatcctcatcattcacagactccatgtttgccaattcatctacttgcaaaaattcctttgtagccccaaaatgaaatctcgcagcagttttgtggccattcacggacctgctcagagtggtgaaaaatttgagtcaaataagataacactctgtctcctggtttcagctctcaaaccgtaaacaagtgtccttcttgcagtctatttggtgccacacttatgcatttttgtgctttttgttgatgatttcactgtttaaaatgccctcgaagtgtagtgctgaagtgctgtctagtcttcctaagtgatattctttatggaaaaaaatagatgtgttagataagtttcatttaggcatgagttatacagtaccattggcattgagtttaatgtcaatgaatcaacaatatatattaaaatgtctttcagcagaaacacacataacacaagtttatatattaatcactggatgaaaatattgtgaccagaggcttaaaggaacttaactctgtatttctcctaggagcaatgggtcagtattcacttattcagtgttcactgcaactttataaggcataactagcattaataatgagaatcaactgcatgtgtatatttgcatgtgtgtgcatgtgtttgtgtgtatatgtgtatatgtatatacatacatatacatatatacatatacatgtatacatatatacatatatacatgtatacatgtatacatatatacatatacacatatatacatatacatatatacatacatacatatatacgtatacatacatacatatatacgtatacatacatatatacatatatacgtatatacacatatatgtatacatacacatatacgtatatacacatatatgtatacatacacatatatacgtatatatacgtatatatgtctatatacgtatatatacatataaaagacacacatgcccatcttgtaaagagtccttaaatttgcttcctgcctttgaaagctaaaatgctgtgattctaggcgtaagcagagctaactgaaacagtcatcctgcttctctgtgtaacccaatgttcacctgttgaaggcaggaccatctagatcatgaagtcatttttcttacaagaacttaaagctaagacctctacctgagatcttcctctgccacctcctgcatcttcacatcatccttggttcactggaaagagccctggcctggtttgggaaatctgggtcatcctgctagcctcacactccctggggccagcagtaaccaccagtgccagtcacttaaacctgtaaatgcaattttcccttatttcatgattttcctcacccaatcacttgggagagctagtgaataaaagtgcattagaaagtctaaagcttcatagaaataggagatggggagataagcaaaagagagtatgggctttgggcttagactggcgctggggaaaaccaactgatgctggggttctgagcttggctcaactgtttgccagcattgtgaccttcagcaaatttcttaacttccctgggcctctgcttctctgggatagctcagagcagattacatggatgaataaggaaagagaaggaggatagtaacaattcccaagtgcccgtacaccacgatgagtgccttgtgcatctcctctaaccttcagaggtatttcagaggtatttctgatccctgttttatagaggtgccaagagtcattctgcccaaggtcacaggtaagtggtgaagcagaatttggactgagattgacagccctgttctgcttgctgccagggaccctcaggaacaccctggtgtaatcatctcttcccagtacaaggcaaggagccaacttaattagagagtttatttataaagaatttcacaaggccccacccaagaaacatgtcagtacctttgagaccagcactgaccttttgcatatgaactgctcttgtgttttggtcaactgatctcacaccaggcctgaagccaaaaccaagaacattcatttcaaaagaatgatttaaacaaaaagaaagaaagaataccaccctctggcactgtgttttaaagacagtgtacaccatctataagccccattttgtcaagagggacagaggcccaggaacagactcatttggaagaaataaattgtctgttcttatgagcactgatgcagaggacccctccatgaaaaacaaagaatatcaattttttttaactgacagacattgaaaagcaataagatttccttttttcttttctctgttttcctggtcatgtctgttgagccatcctgacactgcatctaacaaaggccagagaattcttccccttaagagaccctcagacagaagtggggcacacatcacccggtggggtggggaacattataatttaccgcactccaatcaccaaaagctccttgctgctccccggcatcagacagtcacatacaattcacaaatttgtaaatttttgaggctcccagcagtcctttgaggtggatattgcgtcatgatgtcatcataataggtttgtttgcccgatgcacagtaagtcaataaaccaaggcaacagggattgcagcaaagaaagagtttaataatcatacggcagccaaacaaggaaacaggaggaaacctcaaatccacccctccagggagttggagctagagatttcaaggggtttgaagtgggccaaggtccaggattattgattggtcaaagagtgcagagtaaagtcatgggacagggaaatgaagaaactgcattctcgtgctgattcgattcctctgtggttgttttcaaactggttggcattagctttcctgctggaattcaggatctgaagaacatcttaggcaattcttaaacaaaagccttatgagtccatggtcactgatcgtagctataggaacaatggggatataaatcaattcgtaaacaaaaacctatgattctaaggttagaaatcctaggtataggaacaatgaggatgcagatggtcagtatctagtgctacctgactctcagttacaaggaagtgggccaaagtgtggcctgattagtgcttaatagaactatatttctgcacaggacccaggatgtaatttttgttatccctgtgaggaccgtttcaatgatactcattttacagatgagataagcagagatcaaagaggagaaatgatttgcacagggctgcatatcacacgcacacgttcttcccactgattctggcatccatgccaggggaggtaagactccagagagttctgccaggccttttggaacacagcctatatgtctgctgagggcttctctagccaaaacgctcaggcacagcccattcttaccatcagcaggcaggagaagcatgatcctaaaaccaggggaggccccctgccctactgaggcgtggggcacagggcagtcttccagcaagcttcctggaagtgaaaccagccacatctctggaatcttggaaatagctgtaccggggagcagttggcatcactgccgacaggtggccatggcaggcttgttttccaggaagaccacagatgatgcagacaatgggtttgttacattttggggtgtgtgtctgtccatgtgttgggggtaggggaagcagctttctaaaatacaaacatctgcctccattaagcctccagatcaataggacactagcggcagaccctgatctcttgcttgactcttggtcttcacccccaggagacctccataccaatagctctgtcctccaggggtgaagctggaagacaaaggaggcactgtgatgggccagtgaatgctgctcagccttgttcacgtcatgacactcctagaaaagagtggtagctatacaactcagcaggtcgatggaggaggctgctaacagctgaagagaaggacctagaggcccctggccactctaacagataatggatcagcagccaagggcaccgattcagatgatctgggcaatgggccctgaagtcagacggtcctgagctcttcggtagccttgctgctcagtgtgccctatggaagtactggcagcatccgtatcacctgggagccccttaaaaatgcagaacataggctgggcacagtggctcacacctgtaatcccagaagttttcaggaggctgagatgggagaatcacttgagtctaggagttcaagaccaacctaagcagcatggtgagacccacccccacccccagcccgtctctacaaaaattaaataaataaataaataaaaattagctggttgtggtagcatgtgcctgtggtcccagctacttgggaggctgaggtagggggatcactagagcctgggaagtcgaggctgcagtgagctgtgatcacaccactgcactccagcctgggcaacagagtgagacccggtctcaaaaaaaaaaaaagggagaatgcagacctgtttccagacctgccaactctgaatctacattttaacaaaatgcacaggtgatttgcaggctgttctgcataaccactggttttgaccaagggatgcaaactcagatgcccaagggaccaggcattaccatgagtcagaagcccaggctgggagttcgaggccatcctgcaagagaagtcacaacttagccccagccagggaagcctgatttccagattcttttataacaatcaattctcaggccgggtgtggtagctcacgcctataatcccagcattttgggaggccgagatgggtggatcacaaggtcaggagttcaagaccagcctggccaacatggtgaaaacccatctctactaaaaatataaaaattatccgggtttggtggtgcacgcctgtagtcccagctacttgggagaccaaggcagaagaattgcttcaattcttcaggaagcggaggttgcagtgagctgtcatcacaccaccgcactccaacctgggccacagagtgagactctgtctcaaaaaaaaaaaaaaaaaaaaaagaaagaaagaaagaaaagaaaagaaaaagaaaaagaaaaaaagaatcaattatctggggtctccaatatccagactccttatttttaaatattggcaactaatttaaaaatcttttgaaacactgtatacgtcaaataaaacagccacccacttagggtatcttagggagccagtttagtgcctccagcttcagacagaagacactgaatttggccttaccctctctgtataggggaccattgagcttaatggttaaggccacaggatgtacaaaggacctaagagtttaaatctgactcagccaattcctaattatataaccttgggcgagcacttgacgtgcgatctttgtttttctcacctgtaaaatagccccagttggccgggagctacggctcatgcctactataatcccagcactttgggatgccaaggcgggccgatcacctgaggtcaggagttcgagaccagcctggccaacatggcgaaacccgtctctgctaaaaacataaaaattagctgggcgtggtggtgggcgcctgtagtctcagctgctcaggaagctgaagcacaagaattatttgaacctgggaggcagaggttgcagtgagccgagattgcaccactgcactccagcctgagtggcagagcgagactcagtctcaaaaaataaaaacaaaacagggccagtaaatgtccctagtggaaaagggattaacctaaagactgattgaggtaacgcactcttaaaaaattgtagatacttaagagatgttgatttgcttcctctagcgcctgactgtgcacacagatcacccaggggatcttgttaaaatgcaggctctcattcactagatctgcagtcccgcctgcctggggttctgaatttctaacaagctcccaggtgatatcaatgctgctagaccatgatctaggcaagggtcatcaaagttttctgcacagagccagatgctacctatttgaggctttgcagggcacatggtctctgctgaagctactcagtcagctcttgtagtgggaaagcaaccacagacaatacgtaaatgaatgggcagtgctatcttccactggaactctactcatggacactgaaatttgaatttcatatcatgttcccacttcgaataatattgttctttgattttttttcccgactacagtagctcccccttattggcaaaggatacattccaagactcccggtggaagcctgaaaccatgaacagtaccaaaccctacatttactgggttttcctatacatacacaactgtgatatagtttaatttataaatttaggcacagtaagagagaaataataataaataataataaaatcagacaattatagcaatctactgtcacagaagtcatgtgaatgtggtctctccctctcaatatgtcctgctgtatagtactcacctatttttgggccatggttgactgcaagtaactgaaaccacagaaggtgaaaccatggataaggggagactgctgtttaaaattttgaaaactcttcttaacccatgggctgtacaaaaacgggtggtgcgctggctttggccctcaggccatagtttgttgacgcatgatctaggtcatcttcaactctgagcctggccatctccctccccaaccaggctgtaagctctgtggacgcacaagctgtacccagtgacctcagctcccctccccgcctaggccagggccctggacagcggaaagccctgtcctttgccctacacaatgagcagaagcctgggaagagaaagtgttgcctttcaaggctgacacttctctggtgcctcccttcccctccattcaatttcacggtcacactgtaactctataaacatgtggtttatatgactcaaaagaatcagtgacccgggagctcaataacaacagaaggagttttcatttattaagggaaagagctaagaaaaggaaccagcactgataagcaggataattagacagttccccaaacagtccatcaaaccctgttgttcccatcaccttcccaccaccccttctggcccctggcagcaagtgacccaagcggctggggcaaggacacctttgagctctgagtcctgatcttcagaagggttggaggaggggcaaaggcttttgagaatttgagactaatggcttgccatggtctgaatgttggtgtcttcctaaacatattattaggttcatatgttggaacctaatacccaatgtgatagtattaagaggtggttcctctgggaagtgattaagtcatgaggactctgcccacgtgaataggatcagtgcccttacgtaggaggtgtgagggagctcccttgccccttccgctgtgtgagaatgcagcaaaagtcaccatctataaagccctcatcagacactgatctgctgacacctagatcttggacttcccagcctgcagagctgtcagcaataaatttctgaattatccagtctaagatattttgttatggcagcccagacagactaagacatggctcttacattcattcaacaaatactgatggatttggtgccaagctgtttggagttaaggagtcaataaatgttcattgaatatattggcaaacatttcatgaacatttgttatatttaatcaatgggttagatgctgggatgacacactcatggttaagattcagagatgaaaaagacatagctcctgtataaagggaatttacacatatgaaacatagtcacaggctagacaacagtctagcgcagggcttggcaaactaccacccacaggccaaatctagccccacaacctgattttgttaataaagttttattataacatggccctgcttatttgtgcacataatgtctgtggctactttcacactacaaaatcagagttcaatagtttttatgtcctacaaagcctaaaatatttaccactggactctttacaggaaacgtttgccaatctctggcctaacacaatgcttttccaaaaatgtgtacaataaaccccaatgaggaatacattttgtcttgccacctgattgctagatactgtatattgaccaagataagttttacagaataatacttgcccttactatgttcaaggaattgtgatatcttcagttctagtgtattttattttttaaaatgttggttgtgatccattaagttgatttgatgaccaatttcaaactcacagtttgaaaaatattggcttgactagggtcagtggctcatgcctgtaatcccaacactttgggaggcagaggcaggtggatagcttgagtccaggagttcaagaccaacctgggctacatggcaaaacccatctttactaaaaataaaaataaaaaaatgccaggtgtggtggtgcacacctgttgtcctggatacctgggaggctgaggtgggaggatcacctgaatatgggagattgaggctgcagggagccatgatcatgccactgcactccagcctaggccccagagtaagaccctgtcagaaagagagagggagagagagagaaagcaagaaagaaagaaaagaaagaaagaaaaagaaagagagagaaagaaagaaagagaaagaaagaaaagaaaaggaaagaaagaaaatactggcttactagaaagcaaatcatcttcattcattcgtgtattgaagaagtatttatagcatccaggcactttgtacatgccaggcactattctaggcactggagatgcaatatcaaacacaatcaagtccctgccccatgcagcttacatgctatggagggaagcagatgaagaaaagaataaacaaataaatcttccatatatcaggagatgagaagggctctgaaaaagaaagacaccaagtaagaggcagagtgtgacgaatgtgatcagagaagcctttctgtgaggtgccatgtaaaggaaggagagagtgagtcatgtggacatgtggaggaagggcatgacagcagaaggaacagcacagacgaaggccctggggcaggaacagggaggtcaaggaacagggaggaggccaatggagcaggagtgagtgcttgaggtaaaaagtggtaggaaataagctcccagagtgaggacaggtggtggaggaagatcatgtagacaatgtactgtgatcaaggcagaatgaataaactctaaagcagaaatataagccaagagctgagaatccagttagagtcatgatggaggacaaatctccaatgatattttcatttatcaaaaaaacatgtaagtgtgtgtagacgctgtacttagacaaccacaacagtgtgaggatccaaagatgaatggacattgggcctcccaagggggtccctttctagcaggaatctagccatgcaagcaaatgattacattgtcatagcaggaaatgtcatgggcaacaggagccccttcgagggggtcccagggaagacttccataaaggtgggaaacttcagctgtgtctccaaagataaggagacatcgcaggtagaaaaagcagagcaaactgtccaacacagcaggacctacacacaaaagcataaaggcccaagcaagctgctcagaatggggggaagcagcgatgcttaaccctggcagtgcattcgaagcacccgggaagcttgtaaattccacttctgcccagggcctaatcccagggactctaatgtgattgactggagtaaggcccagatgctggcattgtattatcccctggtgatgctaatgtgaagccagtgtggacaagccctgggctggagtgaggccaggaagagaaagtgagactggggccagatcatgagagtgtttcatgctacactctagaatacaggctttatcttcttggtgagagagacccactggtgggtttcaagcaaagaataggcatggtcagattcataagggaaaaaaggcgtcctggcagtggtgtgaagagaagagaggggtgggggttggaagcgggggattagggccccattaggaagaaactgcggcagttcagagaagagatgataagggtttgtacccaggcaggaagcaaggccgtgaggaatgagataaggatgcagtcgagtgatatgaaaaacggcagacttgaatgaatttgggaactgactgtgccaggcgggaaaagaactcaagattatcacgattccattactgaagtgtacaatcaagaaaaaatggcttgaaggggaaagagaatgggttcaggttttaacattttgaatttgaaataccttacggaaaatagtcaccatcataaaccgtgtatttattgaccgcatactaggtgccaggccctgtgcttcgtagttcatgtgcgttttcctactcagttgtcacagcagctctctggggtaggtaatctgattaaacccatttacagaagggaaaactgaagctcagacaagcgaagccagtgggaagaatggtgaattacatccattatggtgtgcacgggatactcggcacagagcttggcacatggtgaatgctcagagaatggccatactattaatagttattatctcttccccactgtgggaagacctcaagccaggtctgcgagagagggaatcaggaatacttgggagccctgtggatatgtgggtgcctcagagtgtctatatgtcgatagaaccatactcaggccattgcttcattttatttccggcttcctaatgagggcatctcaaatactcttgatattaccccctcaccagccctatcccacgaccgctcatcattattttatttttttaaatttcttcctacaaagttaatctcaatgtactcacatctgttctgttctgtgagggaaattgtgttgttggccacgcagccggaataggtttgtttttttttgtttgttttgttttgttttttgtcttgaggaaagaaggggaactttatttattttttaatatagctcctcttgcctggtcccatgccaaataaacaaagctgctattcatttccgtatctccccatctctaccgtgcccagagtcattttagcagcagcgcctcttgggctgcctctccgagagcctggaacagcaaataagaatgtcctaaaagtgagtgctgtgaaaatagaatcctatttaatgagaccgcagagagcaagaccgttgctctcttggtgagtggaggagcaaacattatgtttaaagttgtggtcggaaaatgctggatcctcaaatgtggcctcagctaaaagcatcagccagtgcatcgcaggtcatgactcaggggcaggtagctgaggcagctgcaggaagaacttagaaccaggctgccgccctctggaagacccccacccccatgcttggggaacccccacccactccctcgccagaacacgtctgtcatggtccttctcttcttgccaccgcatctcaatatcaaagctgactcgacttgtgtcccattcatggaatcacaagtattggggttaaagaggacttccaaagatgtggcgtccaaccttccacccaatgcttcctcaacagtgacctggctttgctcttttgactttgagccctttgtccaatgaacaatgaaaacacttagtatattaaacagatcctagtggagctgttctgaatgaaaaaagaaaagagatctagagacccacccagccgggctcccggcatggcgccattccctccatagaattcagtttgaaaaccacccgcttaggtcaaaagagggcctaggtaccagggtcagcatccctttattcattcagtaaattgttcctaaacacctgctagtgtgcaaggagcagggaatacatttgcgagtttaaaagaccaagtccctactctcatagagcccatattttgcttattattttggagggtatagaaaactattaatacaaaataatttcagacagtgctaagtgcgaggaaaaacacaaaacagagtaatgcaatagcatatgactgggagtaacagatgggctgctttagatgggatgatccatcagctattcagatcatgagaaggcgctgcctagctatgggactggctgcagcgagagctttgcaggcagagggagtaccaagggcaaagtccctgaggcaacactgagcttggtgagttctaggaagtaaaagagagagggagggggcaagtggtaggagatgaggtcagagaaaccagcaaggctaaaccacattagcccctgtaggtgcatgttatgaaacactagcaagcgtgggttgtgttcaggtgctgttggcatcgaacacgatggtgattttttttaaagagatggagtctgtctctggtgcccaggctggagtacagtgacgtgatcatagctcactgtagcctcaaactcctaggctcaagccatcctcccacctcagccacccaagtagctgggactactggcgtgcaccaccaaacatggctactttttttattttgttagagacagggtctcactatgttgtccagggtgatcttacactcctggcctcaggcgatcctcctgctcagcctcccgagtggctgggattgtgggtgtgagccactgtacccggctcacgatggtggttttatttcctgccaaaataatgaaatttggacactttcacttctttcctcatcaaggaaagggccctgagagggagatgagagtcctaacttaaaaataaaaaaaccccagccaagctcagtggctcatgcctgtaatcccagcattttgaggggccgaggcgggaggattgcctgagctcaggagttcgagaccagtctgggcaacatagtgaaaccccgtctctactaaaataaaaaaaaaaaaaaaattagccgggcgtggcagcgggcacccgtaatcccagctactcgggaggctgaggcaggagaatcacttgaacctgggaggcggaggatgcagtgagccgagatcacaccactgcactccagcctgggcgacacagcgagactctgtctcccaaaaaaaaaaaaaaaaaaaaaccccttccttcccctgtgagttttcctttccttttcctttccagttgtaccaccaaaacagagtgacttcctctcgggggctgctgtgtcctctttcaaaacatgagtgaactgggccactcaaaactctccttttgcatgaaatcctacaggaaacttgaaatcatggataaaagtagcattagattagctgtaattttattcaataacttttcatttacaacatgtatgatagagttcatcaagagaacaataaggcccttttgatgaactcagtcctatattagcctcagcacccaacttccctttctattttgtgtccttgaatagcatagtgttgacaaaatcaccagtattttaccggctttctctgcaatctccaaataaaccaagatggaaggagaggccttattctgaggattgcaccagaaaaggtcacccaggcagctcatgtgtgtggaacatttgagtgtcctttttggatgctttaaagtcaagcttttaaatattttattttaacaaaatgacaatcaagccatttgtgcaacatgtcatatccttacctggaatactgaaaacagtcataaactgtcttccagccagtggtgtgctggcaaactggctctctggggaaaacaggggggaaccctaatatgttgtgtttgccagtttctggggtataaatatttccaccacaaatgatttcaacctaacaatgatctaataactggctgacaagatgtctaaatatttaacaatcacctcttataagcaagtctgagccagctccgggacaccattgcttccagcccttatccatggttggtgttcttgagtcgagccccctcgaatgctatcatctgaaaacaaacacccgcagtggcaacgcaaggccctgataactttggctggagccaaggagggccagtgagagtgagatggggaacagaggagtggaagacacgagctggagttgctgaagtcctggggctggtgtattgtcagaaatggccagagagccagatatagtggctcccatctataattctgacactttgggagactgaggcaggaggattgcttgagcccagggggtcaaggctgcggtgagctatcattgcaccattgtactccagcctgggtgacaaagtgagatgctgtgtcagaaggaaaaaaagagagagagaagagaagagaaggaaggaaagagaaggagagagaaaaaagaaagaaggaagggaggaaagagaaagggagggaggaaggaaggaagaaaaggaagggagggaaggagaaagaaggaaggaagggaggaaaggaaggagggaaggaaggaaggaagaaggaaggaaagacaggagggagggagggaaggaaggaaagatgggagggagggtggaagggaagtaagggaaggaaggaaggaagggagggacggaaggaagggaagggagtaagggagggaaggaaggaaggagggagggagggaggggggaaggaaggaaggaaaggaaggaaggagccagaatctgactccaggggcagaaatggtaactcctctttaagccaagctctcccaaacctacctgtactttatacacctcagatcacgtcatagcctaccttccccttgagaatcatacttcaagacccaacttaagtaccttccccgcttaaagcctcctctgcttgcccaagcatgatgcgattcatgccctcctgtgagcgagctctgggcctagcacagccccatcttactgcaccatctcaccatctgcagtttcctcttctgggctagaccttaagggcagaaaccacaactggagcgccaacaccgagcacacagcctgatactctcattagtttactcaacaaataccaactaaacccctacccagtgccaggcagtgttctgggcactgaggatgcagtggtgaacaaaacaaagctgatgccttcatgaagggtttgattctagaagacactcaatagataagactctcgaagtcagtcccctgcagttgctgttcttaggaaggctggcagagaagaactttcattcattttattttaaccctagctagaacccacacataaacagtgccacctttcatagtcttttggttttattttttaattatgactttgggagaaggacttgaaggtgtattaaggtaccatcgccataggtcaagggttgtgggaggaggttgcttgttacatatttatccactataacccattaatagcttaggctgagttgcttcacaggttaggaagccctggccaaaatgatagatggagtgagcttaacatgcctggagataggatgagcaaaaggcctgaggctttgcccctggtggccagggtgccacataaatccaagctcctggaatgggtagagtgaggcagatcctgacctcccagagcaacccagggccagccactcccgctgcctactggttgttctgggcactggggatggaaaggaagaagacaaagtcaaaggaggagagaaatggagaagaaaggaggatgagaaggggaggggggatgctctggggaagtttgctccttctcagacttaaaactctaggagagcctgaaaggccttcctcagactgcctcctgtagcaccaaaagccctaaagatggagtggactgtggtcatgatttaggacaccctacaggtcacccattctgttatttagccaacattttagaaacacacacacacacaattccctcttgctctgcttaaatatatttttaaatggtgttttgtatcactaccatagattatgagttttatgggccagataatttttcctaatacaccttgaaataaatatctaactgttaaaattatccatgttcatttgtgtcccccctaaatcatcctgtgggccaccagtgtcacgcattgtgggtcactggtagagagaagtcagcatcccagtgctgagcaggcttgaagccagtgttggtctttggctcatgggtaagtaaccctatccaagctacctgctcctccctgtgtgcctcagctgcaaaatgagagggttgaccagatgccaactcacgtcccttcacactgagattctaagctgttttttctataagggtagagttgctaaatgcggcatactcagagcacacttctcagcaccccaccctctccctccctcctgagactcctcccccgaccctactacaccccctttccctactcccagatctacctgggagagaaacatgcacagcttcaactccaaaattaaaattcaatgttttaatcagaaaacaaaaacctccaattcttcctaacctcagcacaacgctctagaccctttaactttggtaaagtgagtcacatccccatctgcataaaaaaatctttactgcttttgggaaatgtttacaatggcctttaatttcccagtatttcacaagggagccagacagacaaggagtctagccatcccctggcgggaccccacgctcagcatcctcctccactgtctgtcttttggatatagacaaacccctcccaagtcctgcaggacagtcagcaggctttccagtcctccctagaaggcagtgtgtgtggagggaggttggttaaataccatgtttaatcgacctcggaagctatgcatgagcaagataagtccagccattgtggcacctaacacaccctcagcatggcccgtactaaaaacacttttcagaggactgggagaggggtgtccatgcccagaaaacgtaagccatcggggccagaaaaatgaggacaatagctttaatgctattaatgtatcctggactttacaaaatctctagatacctttttgataaaggtgcttacggttaatgacaaacagctaacattcgttgctttgtgcctggcactgttcaaatcattgggccagtttacttctaaatcttcacagtaactctgtgaagcaggtactattacaaaccccattttacggatgagaaaattaaggtttagagaagttaagaaatgtcccaaggtcacatagttaggaagtagtaaagcctgactcccaaaccatgctcaaagccataccttccatttgtggagtatttcgtatttttaaaactcttatgcatgcaataataaccatcacctagaagaaatagatagattttatatatatatatatatagagagagagagagagagagagagagagagagagattgattgattttagatagatatagatagatgatacattttagatacagatagattttagatcaattgatagattttagatagatagagaagatagatagatagatagatagatagatagatagatagatagatagattttggatggagatagatagattttagataggtatagatggatagatagatatattttggatggatagagatagatagatagattttatatagataggtgtagatagatagatagatagatagatagatagatagatagatagattttggatgcatagagatagatagaaagaaagaattaggtagatagaatttctaatcctcccaactctctgagggtgagtataaatattatcatctccattttacacatgaggaaattgaaccccagaaagacttaagaactcattccaaatcatggcatttgtaagtccctaagctaggatgtgaatctagaccatcctgaccccgtcatctatatacttgcattgtgctgcctgcaaaatttcttctgattcctctaacaactttgtgacttgcatgggaagaatgtgtgtcatagtgcagcctaaacacccatcaaatggaattctacaaacccagcctgattgattagcttcaggaggcccctcagtattcaggcaatacaaagtaatacatcccctaggacactctccggttgtgtctttcaaagtctttgcaaactagctattttctaccaatttgttaccaacctagctagctaggtatccacctatctgtctgctacagatatgttaaaatatgttatatgctaaagtcctaccccccaaggtgatggaattaggaggtggagccttcgggaggtcatgagggcagatccctgaggaatgggattagtgtctttctaaaataggccctgggagcttgtttgtcccttccatcctgtgaggttacaggaataaatcagggcctcaccagacactgaatccaccttgaccttggacttcccagcctccagaacagtaagaaatacgtttctgtcctttataagccacccagtttatggtattttgttagagcaaccccaatggacccaagacactatctgcttatttgttttccatttccctgactagaatatacctgtcttatttatgactgtattcccaatgcctagcacagtaccctcaataaatatttgtagactaaatacaaagccctgtggaagtccagaggaggaaagagaaattcctaggagctggaggaggaactgagttttagggttttgaggaatgagtaggaattaggtagaggagcaaggagagcattccaggaaggaaacaagagcaaaggtacagggagcccaggctggtgtcattcaggacctcccagaggcacagctctccacagcagctaggagcaaaggtctggctgtgcttttgcctgtcaactccaggaagattctaacagccttgcctgtcccgtgaggagctttaatcatccagaggactttatgcagctgtgaccgtccggtcccttctgaaactggggatcatcctcattagcaagcttccccctccaaacaacactgatgcataaaatggccatggctctggcccaaatcagggttggcaagagaaggaggagggaggcagggaacctatacccgcaaggagttcaataaacctcctcttcctggggtttcatcagcttgggagtataggaaagtaaaaacagcagactctgggcccagacaatcttcccacttcctggctgtgtgacctcgggctggtcacgtgctgcctctgaggctcgtcaaccccatctggggatatgtggatgataatccctacttccatgacttcaagattggtatccactgtccaaagtagccaccctctccccgaccacacagtagaccatgccagctccacatgtgaaatgtatcagtccatcccaattttttagctaatgttctgaggcccaatacataacccttttcttccccttccatattaaggaccaattgagaatttgcagaaaaccattgccataagctccatggaggcgggaatcttaatctcttttggctctgtgttctatttccaccacctagcagagtacctggcatacagcagtcccttaatacatttttggtgaaggaaggaaggaaggaaggaaagaagggagggagggagggagggagggagggagggaggatctccgtcatcgttctattgcacctgccctagaacactcaaccttgaatcaatccaccgatgggccttctcctttcctaaactgacactgctgagcacagttggagaaaacctcatcactgatctcatgctcctactacaaatgcctcatctccaaccccagcagggccctagtgggtcctggtgaagcttttacatctccctagtcagttacctttcccagtctcactgtggcatttccagaactttgctgctctcttcaagccccacgtccttcccatcaaagaagagaatccattcccctgtatcaaagttcatcttcctgcacctctgcctgcccccacaccttctttcccatctcagtggagtcttttctcctttgtagatttcattttacctctgagttctggctctcatttccatcatagcctctaggacttggctacctgtccgtttcttctcactcctggcgctcaatgttgctttctgaagggcatctttcaacactaaagaatgttcaagtctcatttagatttgaaaagaataaataagtctttgctgagcccttgtacccctttacctaccttctcagccaagtttcttaaaaaggagcctgtagttgtctccattctctccagctccctgaatcagctcccaccactccacaaagtttggtctggcaaagataattcatgacctccaaatagaaaatcctgataaagtcttcagccccttgttttgcttgctctcctccgggttgtgtcactgttgtacccatctcttaacacacaaactttacgtcactttcagggacaccatgctggctgcctttcctcctttgtctccagccaggctttcccaggctcctttgcaagctcctcttccacccttcccttgagcatccatgtgccctacggttctgaccttgccccctctctctttctcactgtccacagatccctccatcttgcactgtccagtttggtagccatcagccacgtgcacctactgagtgcttgacacatgcctctattgagataggctgagtataaaatacacacccaattccaagactagagttacaaaaaagagaacataaaatatctcaatcataatttttatatagattacacattgaaatgagaactttttttatatcgggttaaacaaaataccctggccaggtgcagtggctcacacctgtaatcccagtgctttaggagacccaagcaggaggatcactttaggtcaggagattgagaccagcctcagcaacatagcaagaccccatctctaaaaaaataaaataggctgggcgcggtggcttatgcctgtaatcctagcactttgggaggccgaggcgggcagatcaccaggtcaggagttcgagaccatcctggttaacatgatgaaacgctatctccactagaaatacaaaaaattagctgggcgtggtggtgggtgcctgtagtcgcagctactcgggggggctgaggcaagagaatggtgtgaacctgggaggcggagcttgcagtgagccgagatcgtgccactgcactccagcctgggggacagagcgagtaaaaaaaaattaaataaataaataaatatataataaaattaaattaaattaaaaattagccaggcacggtggtgcatgcctgtagtcctagctactcgggaggctgtagcaggaggattgcttgagcccaggagttccaggctgcagtgagctaggatcgcaccactgaattccagcctgggcacagggcatgattcggtctcctatatatacttatatatttatatatatttttatgtatgaatttatattttttatatatgtatatacgtaaactattttatatgtatatgtgtgtgtatatatatgtacatacatacatacactattaaaattatgttcacctatttctttttactttttttaatgtggctaatagaaaacttgtaattatacatgtgactctcactggagttccagagacaacaatgctttagacaatcccatccactcccatggtttcacctgcatcattgtgtcacccaaagcaactcagcatagtgataagcagttgtggtccaggagcactgtttaggtgcagtccgagagcactgtttgggtgcagtccgagagcactgtttgggtgcagcccaggagcactgtttgggtgcagtccgggagcactgtctgggtgcagtccgggagcactgtttgtgtacagtcagggagcactgtttgggtgcagtctgagatcactgtttgggtgcagtccgggagcactgtttgggtgcagtccgggagcactgtttgggtgcagtccaggagcactgtttgggtgcagtccaggagcactgtttgggtacaatccgggagcactgtttgggtgtaatccgggagcactgttagggtgcagtccgggagcgctgttagggtgcagtccgggagcactgtttgggtgtagtccgggagcactgtttgggtacaatgcgggagcactgtttgggtgcagcccaggagcactgtttgggtacaatgcgggagcactgggtgcagcccaggagcactgtttgggtgcagtccgggagcactgtttgggtgcagtccgagagcactctttgggtgcagtctgggagcactgtttgtgtacagtccgggagcaccgtttgggtgcattctgggagtactgcttgggtgtagtccgggagcactgtttgggtgcagtctgggacactgtttgtgtacagtccgggagcattgtttgggtgcagtctgggagtactgcttgtgtttgaatcacagctctgtcatttactagccgtgtgaccttgggaaagttacttagaacaatgcctggcatatgaaaagcattcaataaaggctggccatggttacagagaagcagccttggtttatggctgggagctgcgaagccagattcccagtaggcatccttctcctttgctcaccagctatgtgacctggaagaagtgactcaaccctcccggggcctcttcatctgtagcagggcaggactcccagtatgaaagacgtgcagtcatggccggcaaatggttctatcatttggctcccctttgggccctcacagccactccatgattgagtcctgtgttcccagctcaggcatgcgttgcattttcctgcctccctgatcttggtgtcttaggtcagctctgcaccacttctgctctaaactgcaacaatcactgcctaaggattgcgtggccccccagctggcccctcccatccatttgctagggtcctaaaacccagaactggctacctcacttcctctgcttgaaacccaacaggggccgggcgcagtggctcatgcctgtaatcccagcactttgggaggccgagggaggcagaccacctgaggtcaggagttcgagaccatcctgaccaacatggagaaaccctgtctctactaaaaatacaaaattagccaggcatggtggtgcatgcctgtaatcccagctactcaggaagctgaggcaggagaatcgcttgaacctgggaggcggaggttgcagtgagctgagatcgagccattgtactccagcctgggtaacagagtgagactctgtctccaaacaaaaaaactagcaggactccaggttgtccaaggggaaagcctacaggatccaccctgatccatcaacttttccagggtcctctcggcacatgcctcctcacacccactgctccagccacacccaaccactctccaatcccggaacatgccaggctgttccatgttctctggcttttccctccattttatcttccacgagtgtcctacacctgtgtcagcctcatcaagaccaaactcagctcaagttcaagagtttcctgaacttctccccaacaccttcagttgacatgaccctccctgctttgcatccacactgtgtttatgcagaattctggggccccatctgtaatctgctggtgtacttaactttgacatgtctcattgcccttacaggctgtgatcttcataggattattcataataatcatgatgaatgtattgagcacatgctacatgccaggccctgcctggagaacttcccatgagttaatttacttaaacctcttacctatagtgcctctaagctggatactaataaccagcgtacagttgaaggagtgggaacgcaatgaggttatggcaatcggtgagtcagaactgaaagccacatgctctgactccagaggccactctcttaaccttgatttacttttataccctatgcttgcatggtggaaatttgaatctgagagttgagagagggaaagttacttgcccaaggtcacccagtgaggtctcttcccagctggaactggagttcaggccccctggctcttctttcccttgtcctggttgatcctgtgtccttcccatgaaagcctgggctgatgccccccaacaacagaaaggaaggaccctgggccaatcacctgcagacatggcccgaagcaatgaaatgtccatataagattgaaataataagcagggcttaggccaagcatctgctttgtttgcttggcttggtctgttttcattacagacaatctggaatctcgcctgggaggctctgatgcttcctttattctcctgttgggcagaaaacggagtagggtggagcggcttagtgaggaagtgctgacagggggcagagccggtcaagtccactgtcgggcactccccgtgaaagaccagattgtggggagtattaggcagagaccagggagagaggagctctctgtcagggccggtcactgtggggcaatcatttcacaggtgagcaatgtccctccaggccaacccagatggttccttgactaaaggtcgagttctcagaccctgaagaggaaatttaccaaggatcactttgagcaagggaaaagcaaaccttaatgagctctggaggagcccgctgccctgtcctcagcctgacaaagccaaggggtcatgcaatgaaggtgggaaagggcgggaggaaggttccagtcggctggagacgtttcggcaacttttataaaaccaccagcaatggtgctatttgttatccactgtgcaaagtctcatgacgaaccattgaatatgtgcctttcagaattaagtattgggggggatgttatctctttgacagaaccggggtgcttctttttgtcagataacagaatcattggatctcggattggaagaagaattcaacccacctcatgcttggcttcactccttcaatatgctcttccaaccagtcagccacgttgcaggtttatgctggggtgtcgtaagaggaaggaatttgcaaaatcaaatatatcacctagtagaaatcaagatgtggaggaatgtggctttgctgtgcaggcaaatgggctcctcaggacttaaccccagaatgagacagatttgcctcccccaagccttggaggcagcgttgggcctctacaggcttccccacgtaggagcctggcctgcaaactctccagtcagaagcagagtagattccatgctcttcgtgggaaacagaaagaagagaagaatggactggtccacacttgccccgtttctccttcaaactctctgatcagaatgtcacctgctccggggacgggtgagtggcaggcagccgacaggccagggatgttgttccctccacatggaaggaaactgccagagtttggaaataagagatgcccccattatcattcccccaactgaaaggtcctctgctgctgaagaaaaccagccaggaccccccaagtccctccagagtgacaaattctggagactagagcctcagcaaaaataccttctctgcagacacacccataggcaagccaagcaggtttgggcagccagaagccagtgaaggcacctaccctgtatcaagattattttggctgtaaatactagaaaattccagttcaaactggcctaaacaccatgaagtcctggtgatgagtgtctcagtgaagtcaccgatgccctaggctctgtctgtctctcctgctggcctcaggggcaacttccttcttgagcgagttcccctgacctacgctggccgcaggtgacattctgggcttcaggggtctctgttcccatccactaggagcaggaaaaacctggagggagactttctctgtcgtctgactggggctgtccacaaggactctgatcgtgggcacaactgctcctccgcaggctttcccatttgtgggtgggctgaggaggggaaagccgggatccgccttcaaaatgctccagccaaagcccttggaatcatcctccactcctgcatttccttcacaccccacatcctacccatcagcaaatcctttcagctctacttttaaaatatttctagaatgtaccaccctcgttcaagccactgtcccttctcatggggattctatgatgaaagtgggcttccaacaggtcccttgcttttcagtccttgctttagtctcacaacaaagcgaacctttcaagccataagtcagatcatgtgatcccccttgcttgaaaccctccgtggctcctcatgccatttgcagtaaaaacgaaagtcgttgcggtggctctgagaccctacatgacccttccccatctttctgacctgcagcccacctctcagccctccctccactccgctgcatccacatcggcctcttctccaagcacacacgtcaatgtcgcacctcaggccttggctcttgctattgtctgcctggaatcgacaggataggcctgtgacttgtttctgcacttcctttgggtctttactcgacgacgtcttattagggagaactccagctgctctatgagaaatagtgtcccaagtctgaccccccaatcatccctaccccactttatgtaatttattttccccatactgttagcagtggaaccttcagcaacctccattcttgccttaaattcgaccaagaggcctaaggcagagggaaagaaggaggcaggctttagagcaggagtgaaactgtatttaaaagctttagagcaggaatgaaacgaagtaaagtacacttggaagagggccagtcgggcaacttgagagatcaagtgcacagtttgacctttgacttggggttgcttccggggtcttgcattccttctcccctgattcttcccttgaggtgggctgtctgcatgcgcagtggcctgccagcacttgggaggggctgcaggcacagtgtgtttactgaagttgtgcgcatgctcactggaggcgttttgcccttcccagtcacgtgttcctagaagaaggtcatataccagttacatacactccgccattttgcctcttagtgcacaggcttgagcccactcacccaactcctgagatctaatcaggaagctgctgatcaccagtttaaggtcttttctttttttctttttttttttttttgttgagacggagtctcgctctgtctcccaggctggagggcagtggcgctatctgggcacactgcaagctctgcctcccaggttcacaccattctcctgcctcagcctccagagtgctgggactacaggcgccacccgccgccacgcccggctaatttttttgtatttttttagtagagatggggtttcaccgtgttagccaggatggtctcgatctgacctcgtgatccgcccatctcggcctcccaaagttctgggattacaggcgtgagccaccgcgcccggccaaggttttttctatccattaggagactgcctttctctggtgccagctgcaaccaattattattttaacgagacaattaaaaactgcctgaccatcacctgaaagtcgcctgacatttctggtggatggggaagagccctcttggccctcctcatgtctgcctgactagctactctaacagtagcactcatctctcatctccacctaatatgtcatatatctatttgtttatcttcccacccaaccctgccattgtctccttggtgtctacaacagtgtctggcttgtagtaggggctcaataaatattaactgaatgaatgtctgggctttagagtcagacggacgtagttgaaatctcagcttttctgttccagctgtgagtcctgcagccaatgacataaccttgctgggccgcagttgttcatgtatgaaatgggaatagtagtacttacctcataggattgttatgaagactaaatgaatactgtatatagtgcatagaatagcaccaagcacatagaaagcactcgttagaggtagctgtcactgtccatcatttttgttattacaatcactgtcatcattatttattcacaggctgagtcacatggtcccagaccagtgccccaccccagcctccccagcctcttctctccagtcagaggtggggcgggtgactcaggtggtggcagcctgccctgtgagtcagcccagagccccggccatgttagggtcccctggcacagtctgccttggctaaggggcccttgggttgagtcatcagggccatgattccagtgggggataccttggcaatagagtttggctggtacagcttgccctcccgggtccttccaggaagagactaggcacctgccccatggcactctcaaaacctgcactttgccagctcaagcccatctgtcactggagtttgcagaagacccagatgaggggaagtggggaagggaaaagataggaaagagaaaagataggaaaagggaaaagttgcctccatcctctgcattcaaaccagggcaagatcatggacagatcatggggttctgaattctccaggaccagattcatatcctcattcctccacttactagctgggtgctttcaggcaagttcttcgcatctctgagcctcatccctgaaatgggaggaacaacatctccctcccaagattgccaagaggctctactgagtggacatacactgtcttcatgtctttaatccttcacaaagccttctcagctatatcctacagggtttctgagcttcagtaacattgtaaagaggaaggaggaattgcctttctcctaattttcctcctaactcctcattccctcacttgctccaggaaggagaggggccaatctaatccttctttctttttttcattcaacagctatttattaagcacctactatgtgctaggtgctgtgctaagccctgggtagagaagtcatagtctagtggaataggcagacaatgcaaaagcaagcaaataaatacacagttacaaactcaacttggtacttcttggtgagaagaagagattgttaaaagagagaaaaacacagtagaactatcagagaaaaaacttctgacctggtgacacttacacaaaacatatgaaaagtgacaacaagccagccaggcacagaacaatggagaagaactttctgggggcagagaacagcagatgcaaaagcccaaaggcaggaaagagtttgggttgtttaggaagtgccagaccagtaagttggagtgtcacgggcaagggcagagtggcatgtgacgaggctgggaaaggcaccgggtgaacacgaggctcccctcccaattcccctcttcttaggatcacagccttgcattgcctatttctgctgcctagaaacagttggctcataaattatttccagttttatagttgtttacagagacagggcttgtctggatacgtcatggccagaggctcatccagttgttttgaagattaactgagataatacatgtaaactgtgcagtacagttgctggcacatagttaatgcccagtaaaaagcaggaaagatgtcttgaaagaatgagtgtgaaaatgagatgaagccccatgccaacacccactgtgaattgttattttgcaggttaatctccataatcattacaaagaaaattcaggtggactccatcccctcactggggaagacttctgcacccatcccccctccccttgtgaatcagggcccctcagccgcatgccctttgtggtgttggtcaccctctatagaattatctgttcatgtatctgcctctcccatggactgtgaactccttcatgatagaaatggtaccttaataatctttttaatacaccgtttgagcaacattttcttttcagatatgtttaaggactattctaaatagcgagcttactctcactaactaacccacctttgtatgcattaagaacatggtcctgatgcatctatcttgaacagagtttataccatcttaaaaagtgtgatatccttttaattttcctaaagtgtggacttttttaaagtatagattgactaggctgggtgcagtgactcacacctgtaatcccaatactttaggaggtcaaggcaggaggaccattcgaggccaggagttcgagaccagcctgggcaacacagcaagaccccatctctacacacaaaaaaaaaaaaaaaaaaaaaaaaaaaaaaaccaggaaacctatagattgggtcattgggtcattgggtcattgggtatatggatatacctcctccccccagcccaccccataggtttctcagacctgtgttttacatgaggagcagtcaggcttttttccctgggatataacaccagagacttctgttatttactgttagaggagaactccaaaagtcatcacattagggctccagttcccaaactcgacactgagaagtcctggagcgccacagactcatgggggtagcacagtatatttttaattttcaaaggaaacatagcaattctcagcgtctgtcagacgccatgtaaattaatggccgaagtagtttcgtttctagattggatcgtatgtttctttcagtgatgttgcatctttgtgaagctgagtttttggtggtggttgtgccaaaaactaagtaccatgtgaaaatcacgtgggagaggaaatgagggtaatggtgtccaatctgattctaaggttcaggaatttgtgcactgcccaataagcacatacatcccattagtaagtaattgtagttatttaggaatgaaataaaaacattccgtactttttttcaaatggttactaaattgttaggatgtaaacacttaataagctatttcgctctaactacttaatacgtgaatctgcttagtacttctttggccttaagaatgccgtgaaaaaattcttgagatgggcaccataaaccaagaaggcttgggaacctctgctttagggtttttgcaagtccccattgctgcttctaagcctttgatgagctcgggaattgattctgagctaaactctgtgagcatgacctggtattaatattcgtcacacagaacttgtacttaatcctgtcttgagagtctgggacatgcaggctggttaagaatttcctgggaggtaaaacagagatttagtttatcccccttgaccccatccgactagtttcttaatgagctgatacccctttggaatgagctggatgcatgccttcctgttataaaaacaggaaaacaagcatccatttgtgtgcccgggttatggttttattatctccaactaggagtggcctgaacatccagttggccctgccagctaatttttgccagaaagaaaggccacagagtgactgttctgaacctatggtgattatttttggtatgcatcctcctgacttttcactgatttgtaaataacctggttcagtaaattacctcatgcagttatctttactttaaaaaaaccagtatgtcccggccatcacaccaggagggagcatgctccaagctgggacttctatggaggcttgctggagagaaactcagcagggtgagcaactggtcatggttgccttaaatgttttctgggtgattgaaatagggcaataagcttcagttgcttatgtgtttctgtatcaggattgattccaaatcactttctgggaaggatcttggcctcactccttgtgttcctctctcaggggagatgggatgtcccctcttcaagcattattccctattagccttcagctttcgtaagaggatgttaagacccagttttctgttacagcttgtgagtttcagcatcaacctcagggctattgcacctccttttttcctcggcctagactctcttcccaccacagttctcatgactggcctcttcattcattctttcagcaattatttatggaggacctactatgtgccaggccttatgctgggtgctaggggtataaaaaggaataataatgatagttataacatttattgagcatttgtgatgagccaggtgctcttttagtgcatttacatgtagtatctcattgaatgctcaacagcaatccagtattcaagttatccacatttcgttgatgaggaaagtgagacacagagaggttaagtaacttacccaaggccatgcagcgaataagtgatggagttgggatttgagcttgcattttttttgtcagcaaggcaattttacttctagagaagggtgtgtctcgcagatggagcaatggcgagagcacaccggacaagggaggggaagggggtcttattcctaatgcagctagttcttactgctgtgtctttcccctattggctagggttggaccatacagtctaagctaattccgattggctattttaaagaaagcaggggtacgagccggagtggcggggtgaatagtttggctggaaggacggttacagagcaggtgactaaggatgcctaaggacagagagcttgcatttttaaacatgctggtaaattgcctccctagcaagacactgaaggttcctagtcttatgagcttatattttagtggaggagaaaggcagtaaatatattaacagacaagtaatttcagagaggtgaaggtggtaacaaaaatgataataaaccaggggatttcagtagagacttcccagagcggacagggaggagtggccactgtatatcaggtacttggaaaaagcccgtattgagggaccatctgggctgaaacctgaagcaaccagccacagacaatattcaggaaaattgttccaagcagcaggaacagcaagtgcaaagtcactgaggcaggaccaagtttggctgaacgcaaaagagagatggccagacaccacctctccaacctgggctgcacacatctgcctgcagagcttcaacagacactggtacctccggagattttgaggaaataagcctgacatttggcctgggcaaggggaattttcaaaggagatgatggcgatggtccagtgagggatgatgatggtgtggaccgtggtggtggcagtggaggtggcaatgtctctccttcagctgctgctcccccatgtaagatttttaagtggctcaaagccagcctttctcccatacagcccaactgtagtccacaggaagcatttgcattctgagcctggataaactctgggatgtgggccaaccccaaaggctgggatgctcacctacagatgccctagggatcagcaccagttcaccaggccccacctcactgggtgtcccatagactctcttaccagacctatctaccaaaaggccagagtaggctgacacaacattttccaaagaaaccaccatttcaaaaaacttccctaatctccagcaacctaaccttgttatataatacatgggtgagtctgctaggtcttgactatagcagtctctcatagcacactttgggaaatagcaactttgtcttcttgattcatttcagactgagacagaatgagacccatttctatcaccttacattattatatttatagaatatttccagacaagtacaaagaaatcttatcaccaggaggcttgaggtttagaattattttttttccagatttccttttgatatcttttaccttttttgccatgtctgtatataattttttcaagtaattaataagctttatttaaaaacggatcaaaatgatcactgcattgcatttattggccatctgcaaactgctttctttgaatcatgctttaaggagaggacatgaggacatgagatgctctggactgaattgtgtccccggtaaagcccatatgttggagccttaatccccaaagtgatgggatttggagatgggatctatgggaggtaattaggtttagatgaggtcacgatggtggggccctcatgatgggatgagggtccttataagaagagataccagagagcttgctcactctctctctgtggcacatgaggacacagccagaaggcagcaatctgcaagccaggcagagcgcctcaccagaacctgaccatgccagcaccttgatctaggacttcccagtctccagaactgtgggaaataaatgtctgctgtttaagccgcctagtctctggtattttgtgatagtagctccagtagagtaagacagaagcctaactaagtgacattataggaaacagccaatcatcaaagagcattgttgaggcttacatttgttacatatcgcagtgtcctctataggaggagctcaggagaaacatcatatgattttattgcaagaatgggttgtaaatctcttaggcacctcgtgctttttcctcttagggagactgaatcatgttactgatcaaagtttcttttcttcaacagacacacaaaaaaggggccacatctatatccagacataaccactgttaaccccagtctaagtacaattttatgtcctcatctttgtttttctcctttagtcctgcttgtttttaacctaaaagtttcaaatatatacaaaagaagagaaaatggtaaactggaaccccatgtacctttagcctcacactaaaaaaaaaaaaaaagaaaaaaaaaagaaaaacctttgacccaacttcaaccattatccactgatgctcaattatattttatgtacatctccaatcttcctctcaaacacctctggatacttttttcagatctaattctcatgctataaaattcacccttctaaagtgttttcagttttttgttttttgttttttgtttttgagatggagtctcactctgtcacccgggctggagtgcagtggcgcgatcttgctccactgcaacctccgcctcccgggttcaagcgattcttccgcctcaacctcccaagtagctgggattacaggcgcccgccaccactctcagctaatttttgtctttagtagaggcagggtttcaccctgttggccaggctggtctcaactcttaacctcgtgatccacccacctcggcctcccaaagtgctgggattacagacgtgagccaccgcacctggccttcagtgttttttagaatatctacaaggtggaagcatcaccgctgtataattgtagcacattttcattatcccacatcaattagcagtgactacccattcctctcccccaagtccttggcaattgctcctctgcttcctgtctctgtagatcactggaatattttaaagcaaatctcagatatcaagtcatttcacccataaatatttcagtgaatatttctaacacacaaaagcttctttttttgtctctaatgtagccaaagacctaaaaacataataataattctttaatatcatctagtatatcatcagtgttcaatagcctcctgttaattgatgtgttccattgtatgcagacaagtccttcatattcacatggttagtatgacataagcctcttatgatctataacagttcagtctcctctgttttttttttttccttgtcatttatttgttggtggggggaggccatttttcctgtagaatttcctacatgctaatttggccaatggcagctccatgttgttcctctatcacctgcatttcctgtaaactagtagttaaatgcagagatttttatctgaatcaggttctggattctggcaagaatacttccctggtgcagggtgggggtaggggccattatcttgcatcacatctgactggcaagtctctctgttgagatgtcaagagtggtccttgagctcaggtatcgtctgcctgatccacacattatcaagtttcccatcagcctttccccagtggccttggcattgatcagcattgcctcaatctgttattgcattaggggctgcagaaggatgatgtcctaattctatttcttttgcatttagtagctagaaaacatcaaagagaatatttcttcatcactgttatttacccatttattttggaatagtgagatagtgtcttagcaccctccaaacatgaccaatgatctttttgtcattggttattaacaatttgatgtatttcaatctattgaagtcactattctttctgatactcaagttatcccatctttggctaatgggagcccttttgagttgatttatgtgtcttcttgacatggtagctttccttttactagcatgataagatgttttgaactcatcttgtacattttctgcccaaacctggaatcagtcatttccccaaggagccatggaagcctttcaataacataatgggttttagagaccacaatctgggtgctaaatatgtttattcttatttttttttttgccatttctaggcctttttggcagacacagggaaaaatgcatatatgtttttaagagaaaaatacatcataaattcatcctgatattttgaattcaaatcttagattacaacacttatttattttattttaaaattgtatctcttttctcttatatttaaaaatcttgggtcctaatagcattattactattatcatggtttaaaatagcaataccattattattactaacaagttgaataaaattttatatttcttagcagttttaaaaaatcttttggatattttctgctagggatatatagttactgttgtgttgagctttttttttttttttaatgtggttaaacaaattatagaacatctaccatgtgccaattactgatcaggctgttaagaaataaattctagtgtgaaggacagtcaaataagtatattataatactgtgggttataagtaatagtaagaatttattcatctaagaaatggaatatcacagagatccacgtgctcagccttctgttacaaagtcacttgaaataattcttctctgtaagtttaagccactagcttaatatattgttagactaactttattttgttttctgttttcaggaaattctttctccagttgatttattttgttttataattaataaccatttttgcttgattccaaagccaaaattataaaaacaagatatatacagtgaggactagcctccatccccgtcacctcccgcttcccttccctctataggtaacattctcatttggttttggttcattccttcattgcattttttttttttgagacagagtctcgctgtgctgcccaggctggagtacaacggtgcaatctcagctcactgcaacctccacctcctgggttcaagcaattctcttccctcagccttccaagtacaggtgcacacaaccatgcctggctaatttttgtatttttactagagactgagtttcactatgctggccaggctggtctcaaactcctgccctcaagtgatccacccactttggcctctcaaaatgctgggattacaggcgtgagcctgcgcacccagcctgtatttttttaatcaaatatgtgcattgtccacaaaaaaattcttgataaaagtttgcatgttggctggtcatggtgactaatgtctgtaatcccagcactttgggaagccaaggccggagaattgcttgagcccagcagtttaagaccagcctgggcaacatggtgagatcctgtcactataaaaaataaaaaattagccagatgtggtggcacatgcctgtagtctcagctactggggaggctgcggcaggaggattgcttgagcccaggaggttgaagctacagtaagccatgatcatgccactgcattccagcctgggtgacagagggagactctgtctcaaacaaaaaaaaaaagcttgcatgttatcctcattattctgcaccctatttttttcacgccatagcagtatgtagatcctcctcattgccttctcttgactgcaaagcattcgattgtgtgcatggagcaccatggatgcagctgtcccctgctgaggagcatgtgggtcagcagtcaatgcaccatcccggtggcagtccgccctacataccttcttatcccaaatgcctcctctggccagaggaccatcccaacatccctccagctccatccacagctctaggccgcccacccctgtcttcagggtctcatctaacttcatcctgtcctcaaggcttaaggtggagctataaacctctgagatcatagaacatggcccaattgttgacagaaaactttcttttacacgtagtgctgcaataaacagccttgcgtgcataccatttcatgtgtcttccattatatctttaggatggatgtttaatagtggaattactatcatccggcttttaattacgtctcatgttgtatgttatatatctttgaaatttgccataaattctttctagaacaggtggcataaaaatataaatattttaggccaggcacggtggctcacgcctgtaatcccagcactttgggaggccgaggcgggcggatcacaagatcaggagattgagaccatcctggctaacatggtgaaaccacgtctctactaaaaatacaaaaaattagccgggcatggtggtgggcgcctgtagtcccagctactcaggaggctgaggcaggagaatcgtttgaacccaggaggcagaggttgcagtgagctgagatcgtgccactgcactccagcctgacgacagagcaagattccgtctcaaaaaaataataataaataataaaataaaataacctgaggctaggcaccatggctcagccagtaatcccagcactttgccaggccaaggtgggcagatggcttgaactcaggagttcaagaccgtcctggccaacatggtgaaaccccatgcaggctcggaacagcaagtgcaaaggccctgaggcaggaatatgccaggtggattctggatagagggaggggacagtcttatctgatctctgctggtgaaaccacacctggggtctgttgtgtaattctgggtattatgtagtttaagaggttgtcaaatgtgggcgtttcatgatggtgaagggcctggaagcagctcgtattaggaatgggttaaggaaagaatgacttgtgcacacctgggtggctctcttcaagtggatgaagtgcagacacaaggcagagggctaagacttactccatagaataacgagggccattcattcattcctggtgtgatatacaccagaacaggttagaggtttcctaaaagggattgagctgccctgcctgatagtaagctccctgctattggagatattcaagcaaatagcagacagtctactaagtatgtagatgactttcccatcccgggttggattttgtaatttggaacaggagacctctgagccaaaacccattcagaagatttggaattgcatcctgactcctctctccactttctctgcctctgtttccactctccctccttgctcagcctcaggacagagcacacatgcatgcatgcacactcacatacacacatgtgtgcacacaagcacacaagagggtaaagcaattcagaaagcaagagaggagaagagtgtgagaacctgaatggggagaccatgaggggaaggaggcaggaaagacagagaggaaggaatgaagaagaaatgagaaggagaagaagaatggcaacattgaaaagaggtcaggaaaactgaaggagacagagaaggaggtggaagggagaggctggagaaagataagagaagaagtaagcaacaaggaaaaatcaaggaggaaagaggtgcaagagggaaacagatggcattaaaagcaaaaggaagagtggccgggcatggtgactcatgcctgtaatcccagcactttgggaggccaaggtgggaggatcgcctgaacctacgtgttcaagaccagcctgggcaacatggggaaatttcatttctacaaaaaatacgacaaagaaaaaacagccaggcgtgatgtcatgcgccggtagtcccagccactcaagaggctaaggtggaggattgcttgaacctgggaggcagaggttgcagtgagccctgactgtgccactgcgctccagcttaggcgacagagagagactctgtctcaacatcaacaaaaaaacaaaacagagtaagagagaaggcaaggagtgttagaggaaaggggagaaaagggagggaggagagagtgagaaggcaaggacgcaagagaaaggagagagagaaggagagaggagataagagaagggagaagaggggcgagggaggcaagggtgtgggtgggtctgttttggagagttcacagtggccccatcatagcccctggggcagcaaatgggtaatcttgaatcacagctcattgagggcttcctgttttcagcttgtctttgtgaacccttggagggatttccagccagtaaataaagcggagtgccaagactccctgcccaggctagcagccatttcaccatcctcagggctgtgtccccagtgccctctcaccccaactaccctctctggcctgaggaccatcccagagtcccctccagcacccacccaccgaggctccagaccacctcccctcttcgccagaatcctggaattcttccggttctcaagaacttgtgaggcaggcagtaaccctcagagagcgtagcacctacccaagaatgcatggaaatatccaccttataaaagacaagtttccttgaaacagtttctttgcctttttttggaactctcttgtttttccttctagtttcttgcccccctcccaaattataagcaggtcttgatccaaccttcttaaattcaatccagcaaacttgtgtagagcatgtacaatctgcttggcaccagtgcaacagctggggacaacactcgtctgtcctcaagaagctcacagtctaatggggagacagaaatggtggttccaggggtagaatccgttttttattgcccaggtgtcatacaatgtgggagaccctctgtaaagaaaaagaacataaaatcagctggatgtggtgacgcctgtagtcccaactactcaagtggcagaggtgggaggaatgcttgagcccagaagttcaaggctgcagtgagtcatgattgcacaactgcactccagcctgggtgacagagtgagaccctgtctctttaaaaaaataaataaatagaaatagaaaataaaataaaaaggaacatttggccagggcctctcctgaagctttgaaatgcctgtgtataagatacccgggctcacgcctgtaatcccaacattttaggaggctgaggtgggtggatcacttgaggtcaggagttcaagaccagcctggccaatatggtgaaaccacgtctctactaaaaatacaaaaattagccagccatggtggcacgcacctgtagtcccagctacttgagaggctgaagcaagagaatcgcttgaatccaggaggcagaggttgtagtgagccaagattgcaccattgcactccagcctgggcaacagagtaagtgagactgtctcaaaaaaaaagagagagagagagagagacctgggttccatgctcactgttggtgacaacagaatgggaccccagtgcacaaccactcaaacgaagacagaagagaagggttcccagagggcgcctgcccactcctgcattaaaccactatgtctgtgctttctccctttgctctctttgtctactctgtgaaagaatgcatgatgtattccacaaaaatttacttagggcttgtataataattgggataaatttcagctgccataacaaagacttacaaaggcataaacaaactaggactttctttctctgctctgcacaaaagcagcccagggctggcctggaactaccatggtttcatgaccatggacttcttccatcttactgatcatccatgcctggtgtgttgccctcagctacactgtcaaagatggtccacactccagccagcaaggggagagaagcgaggagtacaaagccctcccctgccctttaacggcacagcctggaagttcatacacctcttccgctcacatcttgttggccaaaatgtggccacacagcggtatgaagatgccagggagaggagagagtgtaaagtgtaccctggatggacacatgccccccatatcagggtgcatcatgactgtaaagcaggaaaatgatgctgtggacagctagacacttccgaggtagcccactctgtgctcagggctgtctaggaaaccaaggtgccaaagaaattctggttctttccaaggccaccaaggacagaaatgtgagttaaacaagccgtccctgcaaacgctcacccgattctttcattttggcaattccgattctctccacctgaccctgaatactggctgagatgaaaccccaggataatcaaaggggcattggaagaagaggtggcaacatagactgtgaagaagttgccagaaagaagggtgagaactgggaaaacagtggtacagaaatcatatttcccaaagttcactaatttcaggtgctacagagggtcaacgcagggcaaggaccagaggcattctatgggatttgccaaagagtggactaaaagggaccttggccaaatcagtctcaggagaatggtagggagtaaaacctaaagaaagtgggttgaggggcaagtggggaatgaagatgtagagatagacagtggtgcgtaactgaggttctgaaaagcaggaacatgttgaggagaatggtggatccttgatcacgttaatccaaagaataaagaatcaatgaaaagcaagagagtaaaaataatgagcagaaatgtcatttggctgctttaacaaagacccacataataggggccaggcgcagtggctcgagtgtgtaatcccagcactttggaaggccgaggcggaaagatcgcttgaaccaaggagtttgagaccagcctggtcaacatagtgaggccctgtctctacaaataatcaaaaactagccgggcatggtggtgcacgcctgtagtcccggctactcggccggctgaggcaggagaattgcttgagctcaggaagtcaaggctgcagtgagccatgatcatgccacagcactcagcttgagtaacatattgagaccctgtctcagaaagggagcttcacagtgctagtgacccaggtccttccatctttctactcagccatcctcaacatgcagcttccatctcatggcccaagatggaggctgctgctcataccatcatgttcacattccctgccagagcaaagaaggaaaaaggacggggaagattattttcatcttcagggcaccacccagaggttgctaatatcacggctacccaggtttcaccggccagagcttggagactcaggcacatctacccgcacgacagactggagcaaagtaatctctggctgaggaggccaggtacccagctaaaaccaagggcttagaaggcccagaacaaaggaaggaggcacaccaccgccactgcagctgggaggaagaagtggggtagctgagtttgaaaagggctggaaaatagggaactcttgcctggtcacctttattttctctgcaaattgagacctggagtcatcactcagagagccaagaagagagatggcttttccagcctctctcctgttgctgtttaggtccgttgtggtagaacaggcaggcacctacttacagacccctgagatggttcaaggaaaagctgtgccttcggagtccagagtttcaagcctagctctgggctcagctgctttataaccttgagcaagtcaagaaatctcagtttccttatctgttaagtgaccacgacagtgcccagcctgcctgcctgctcacaatcctgtttgggccccacggagagctgtaaagactctgcataagcatcaacgctggtggaaatgtgagtgggcattcttgtgggagggacagagttgccaaggcaaagctgagccacaaagggcaggcagaaaagggctgagaggaagatcggaaggacgtgagatggggtgtggccgagaccaaccccacgtggaccgcctagtgcccggccactccacagggctctgcccgtctctgacccagcatcagaactcctctgctgtcggggtgagggtgacagggaagtggggagccgcttctggacaagcagggctcccgtggccagtgggagggagcagctggcccagctgtccacagccgctgggagtcagcctctgttctgtcttaagatcactatcatagagccttggcctcgtcctctgcgcttggccttggaagctctcctgggacctctccccaagcccaggacacctctctgtgttcctggctcagtctagtcaacagtgtgagtttctctcccagcctctggcctagcaaagctggcctctccagtgtgtgcctgtgtgcgcgcgcacacacacacacacacacacacatacacacaaacagaagcactgcatactatataccacatgtacaacacacaccacacacagcaaacacaccacacacatatcacacactacacacacacacagaagcaccgcatactacacaccacatgtacaactcacagcacacacagcaaactcaccacacacacatatatcacacactatacacacacacatatgaatacacaaagaacataccacacatagcatacagcaaatatgcaaacacaccacacacagacatctcccacaaactccacaacactcaccagcatgcatgctccctacacatacacaccatgcacacatgcacgctcccttcttcctaatggcccctctgtgtctcatatcacacccatccattccatcctctacacagctgcttcagtgattttgctaaaacgcaaactacaccatttccttatttaaactccactccctcttccagtggctttccagaaaattcaggctaaaaatcctagctccttcccagagactgtggccctccacagtctgttcccccatggcccgtgccgcatcccccatcagcgagtctgtgccacctgccctttcccccactgtgggttcctcgtgcatctctggaggatggccccactacctacctcatccatctgaaacatgttcatccttccaaacccagttcagagctcacctcctctgtaaagctttcttgaccacccaagcagaatcactcccttcctctctgcagctcgtgcggtgtgtggtggaatgatttgcttcccgtgtctgtctcccctgccagcaggtgaccttctgaagggaattcgtgtctatagacagagcacttgttcctggcatagggtgggctcagtgaacacggggtgggtggcactcatccccctcatcctcccacacagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgtgagtctctggggcaggggctgggggagtgtgggaggaaggcagcccagaggtgcatgtccagccgctgtctcctgcacccaagggtgcatcattatcctccttcctgtctccttactgcccttcttctctgtccagtgtggctgaggggctgatgtccagtcactgcttatccctgggcagagatctgtctacccaagcaagggctgtttcctccagagcaagaaaggtgcttggcatgtctagggaactgcacatacacacaggatatatgtctttgagagagaaatttggggacaaatcaaggagggctttgaataccttgctgagggttttggagtatttttctcttctcttctgagcaaagggtctgatctgtgtttataaaaaggtgaccatgaggctgggaggtgcagaacggtttctctgaagccaataagaccagttaggaggttacaccagatttctctgcctgcaagcaacagaaaccacatctcattaacttaatgggtttttaaagggaatttactagaaaaccatgggttatcagaaactttaaaaaagcaaacaaaaatatctcccaactcaattatcaatttcagaaacattcagatacagagtagccccaggaaggtgggcagccagaaataataataaacaattttcatggcatccctactggtaaatgaatctgccctagtcattttcaaggcttaactcaagattgtgattccgtggaaaaagtactgattagtccaactttgatcgcattttattgattagagaaaagcagaaaactttataagaaggcatgcagtgtgggcagagccattgcccagtggaaatagaggtgctgaatctagaggaaaaggaaagaatgccaggcagagaaaagcagcccgccttcaccctagaggtggttcaacaaagcacggattacatggggctgtggttataaggatgaatggggacttctggaataggcagactgtctcgttcttgggagaggtctttgctccaagccctctctatctttcactctggaatgttattgttagttccacttgaaatgatgagaccccagagggccaatcgttgcctggttgccaagcatttatggggcactgactgtgtgcagggctccatatctgaggactgcaagggttagccctggacagctggaaagtccctccatccgcaggcttctgtgtgggtagcttgtgctttaagctagggttggcaaaccacaaccacaggccgaatccagctgccacctgtctctaaatacagttctgttgatcacagccatgcacgcccatttatggattgcctgtggttgctttagcactacctggattgcctagaccaagggtcagcaaactttttctgtagagggccaggtggtaattttaggcttgacgggctatatcgtctctgttgcaactactgagccctgtcattgcttgtgaaactggaggaggtgcaggcagttgccctagaaggaagtgttcccaggaaagggatggagctcattcttgaggagtaactgccctattccactaatcaacctcttcctcctgtgaggcaagccagacctgccactgctctcagatggcctcggggtgataaaatcacctcctccctgccccctctgagttatggcccattccagtgcgttcctgaggcccctgccttcagccatgatatcatttccctcctctcttcattgtttgagcttccacttgacattgacgacaccttgtcccagtttttttttttcttgaggattacctcattgcagcatttttctgctgagcctccctggcctgacagctccactttgtcattacttaccgagtttcctggaccttgggctggcccatctccaaaggagggggttcatgtcagacttcagtgtagaatttccccggccattcaaccccctctctggcccactccttgccctgcactcgggcctttgtgcttgtcgctactgggctgtcattctttctaagtcctagcagacacagtaaggaagtacatgtgtgtatccttacccgtgtatacacatatatccataattttttctatatgttcccatccacatccctatgaagctaaacagagtcctatggatgtccctgactttcatctggtaccacttcgttcattttagcctttcctgattgctaatctataacttcccactccaacagagaaaaatccagctcccccatccaccatctattccacttttttggttccatctcagtgtatgtgcccagtctcagaatggttcacctgtagctccatgggaaacaaccttgccaactacggtgcagtgccttatggctcctggtggtcatctattctcagcatttttacttcaattttctcttacaatgatacatttttgtgtcaattcctctcaccagttcaccctttgatctcaatgacatagcttcccttgaccgtaagacaaatagctttacctccaccactatgcttaaactcgttcagtctttgccgaggccagatgcatcattagtgatagatagcttgtctggattctcccccagtgtacacagttcctcacccagtaggtgcctactgggcacctactacctgccggatcccactggatactgggtatacaggggatgaagttaaacatgtcccctaccgtcaggattctcctccatcagagaagagaggacactaatgcagtcatcagaagggagatgagcattactgagcattagtgtagggcgtagtaccgggcagtctatttttgctgtgtaaaggtgggctgtcaggaagtcgtatgtcagatgaaacctgaaggatgagcaggacttagggaggcaaagatggagacaaagactgtacggagtaaagggaagaagacctgcagaggccatgacattgggaaagagccatgggcagtggagcaccggaagggaggtcggttgttactggagcagaaagggcaaggaaacagagaaggatggcaagacagtcagagaccagaaggccttcctaatcttcaccagagaaaagtagtcacttctctctaaggatcacttttctaacattttggggccctcaaaagattccagaatcaccaggggctatacacactgccctcattctcctcaaaaacaggccaaagtttgggggatttcatcagatgatgtaggcattttttaatttaatctttcaatttcaaagatgacttagaaaacaatacctaggatccaacaaataaaaaaggcaaacagcatgaagggaaataaacataggaaaatatagttgaagacaaggtgtgtacgtaagaatacatgccattacgtgagccagttatttgaatcagagcctcctaacagccaaagcaaagaaggaaagcagatcagtgacgagggtccctaattccctcaatgtgttgtttgttctggtacaggagaacctccatctctgggaactggaaggccaacacaggctctgccatgctggagcaggtggccatgacagagaggtaagagacaaaggaggtgtagggagaggcactggccatagtaggagctgaagggggaatgcaacaaaaggccctgaagagaaggccactccgccctccgtccagtgcctcaccatccacagagcacttttttagacatgatcatcttcactgcccacagcaacctacagggcaggtattaaaataaccccattttacagatgggagaagaaaactcagagaggggaagtgatttgtctaggatcacagagctagttgatgacagagctgagagtagaaccctgatgtcatgactccaagtccgaggtctttccagccctgaccagctgctataggaagaggtcaggaagccctggccagtccctcctgtgctctgacagctgcaaggaagcattattaggagaccaggcatattggagagtccacttctctctcaagcgtccttccatctcaatatgaatagggaaaggttgacgtcccatgaatcatgcatgttttagggatgctctctggctgaagggtttttcggtctttctccctttagacactgtgtgccagccccacttaaggaagtgccggccgggtgcggtggctcacacctgtaatcccagcattttgggaggccgaggcgggcagatcacctgaggccaggagttcaagaccagcctggccaacatggtgaaaccccatctctactacagatacaaaattagccaagcatggtggtgggtgcctgtaatcccagctactcgggaggctgaggcaggagaatcacttgaacccaggaggcggaggttgcggtgagctgagatcgtgccattgaactccagcctgggcaaaaagagcaaaactctgtttaaaaaaaaaagggggggaagggtcgaagggccaagtcagctggtctcagggcctgccacatacataccttcttgcctgcatgccctgtgacctctgctagcagccacacaatagcaatggacagagcatgggctgtgaactcaaaaagctctgttcagtaaacacctattgagtacctactgcaggccatgttgtgctgagcgctaaaggatgaaaaaatccaatccttccctctaagaactctgtatcggttgcaagggctaccacacaaaccaaattggtttgcgcagaaagggggatttactggctcatgtcactgacgactccagatatacagtgtcaggtaaggccttaaggctcctcctctgcccacccaagttcagcttctttgtgtgttggcttcatccaggcaggctctttcatttcatggtggcacacagtggctccaggctttcatcctcacagtgtcaggttcaaaagaaggaaaacttctgtttcccagtcatttcaaccaaagcctagaactgagccatatgtactggttggcctggcttaggtcacatgaccatccctgaaccaatcactatggcccaagacactgcaacgctgtgattggaggcctatgtcaggtctgcacccctggagactggagtgggagcatcccctacagcaacaaagactgagtgtgaccttaggcatgctcatgctttctgagcttcttcaactgcaaaacgaaagcagtagtaatacccaagtcagagtgcaggtgtgaggactgaatgagagagggctgcacctaatccagaaccagcccctggcagggaggaacacctgtccttcccatcaaccccagggggcagctgccaccttcaacctgggaacccacctgtgctaatgagtctcttggaggctgcgctcatgacctggcacgactgaatcatgtggctgaggcagtcacctccttcccccaacaggtgttcacgggacagtcgtggccatcttctctatggcccttccggaatgtgagcccagccttccccagtgcctcctgagccactcacagatgtccccagcaggccacctatccctggctctgccaagtcccaggctgcatgggccatccctggaggaacctaacgtgggagtgggcctgcccaggcctggaatccactttcccttttccaatcacaggcagaactccagggtctgggctggagagatccccagtcctatccccacaggagcaaaatccatacagggactcatacacagggcctgaccccgccctccactggctcgcctgcttgccaggtggcctgactcctgggcaaaaccaatgatgtcgcttggtcagtgctagtcccacctggcaggaggggagcagggccccccccccgattctccaagcactctcacgctgctgtacgcctgcagccccttcctagaccctgggatgcctgtgccctatggggcgtagccagcaggggaccccaaggttcatcctttcaaaacagcctctggaaacagctgcctctggacctcagctcaaatttccacgttccattgagaagaaacctgatttatgagtgtgtctcagggcagagctcaccctgtgtgtggcacccacaagtcagccactggggccaaaaacgaggaccctgatcagagagcccagaggattcttcgagctccaaggacccaaggttgtccccaaacgtggccacgtatcagaatcacatgaaaagctttaaaaaattatagaaattactctaacatagggtggagccccaagtctggctgtttgtgcgtttaactctcctggtgattctgatgtacaaccagaatcagatctaggctttcccattttatgataagagggagaggcttttccaaaattattaaggaattaatagcaagaatgtaggtccctggtctcccatgctgagtgagaatggatgggctggggcaccttcagaatgagaggaagggtggcttgcttggaagctggaatcagacaggatctggatttggaagcggtacagtcacttaatcatcgctctgagcctgttcctccatcagtaagatgggttaaaaccttcctcatagagttgtgctgggattcgagggaatgaggagtcagcccccgggcccagaatgcctggaacataccaggagctccatgggtgtgagtctccatccttctttttatttgatgatctcacatgctccgtgctacagctgaatgagaaaactggactgggagtcaaggagatcgagggaatcctggtgttcttacaccttactgtgtgatctggaccagccaccctccctctctgggcctcagtaggctttggtggatgagatgagactccattctaagagcattccagtcacagtccctcctcatcccagcacttgtggctcagagacgcaaagcgatgtgagagtaggcgtgccccgtgtgaccctggagagtgagaagcaagaacattgacacagagtcccctgtgactcccaaatccagcccacaggggaagctaagtgcaaagctggaacagtttcttcacatacaaccacccccttgttgcagggtcagagtccagtgctgagatctgtccccagcaaagcaaactggccttgcagacatcaagtggctggaaagggaacaaaagcagtgggtctagagggccaggccccctgggcgaggcagaagcagcctgccagtctccccagcccacccgccccgggccctgggaaaaatgcaccctttgtcctccacagcctcttgtccggccagggctgggactggaagggcagcctggagggacttctggagcccttggagcagctttcccaagggaaaagggacacaggggtggctgggtgtccaggatgactccggatggggacagggcaagctccccattactgcagagccagcaagtcctggggtcgggggagacctctcccaactctggttccttctctccctgcctctctcccctccttcctggctctctcgtgttctttctctgggtctctctctcactgtcatgtgtgtccctgcctctctccctgcctctctgtctctgcgtgttggactccaactctctctccgtctttctgtctctcttgctgcttctctgtctctctccatcgccgtctggatgtgtgagtcactgtccctccctgcctgtttttccatgtgaatccacttctctccctctacccgcttccccactttcccaggccacttcactgtctgtccatctgtccctgcaggtacaggctgtgggtggacagctgctcggaaatgtttggcggcctggacatctgtgccgtcaaggctgtccacagcaaggatggcagagattacatcatcgaggtgagggatgaagcagggagtcctcctggctggtccagcctggcaggcgtgccagggggagggaatccctgcatggtctttggcaccatcagctgtgtcctggctccagggcacacgcaacccaggcctcagtgagttgcttctggaggctccttcccaccctcagaggcatcgaaaggcttcatgcctggggacttggaactgagtcgggagacctcagggcccgaggttgaacaacatccccaacccacaggcctaagggaaggaaagggcatctggtcaagggtcaacaagatactgtcccatggggccccttccatttccccagtgtccaagcatgtgaaatgggcaccttccttggtcaccatgcagacagtccatcatttgttcattcaacaaacatggccttagggggctcccatgggctaagcatgggtgtggctctggggatacagccgtggacataatagacatggggtgtgcaggctggcaggggagagggtgagaaacagtggcagagcattgaggatttggaagggggatggaatggtacaggggcatgaatagagggaaagatgtagggaaacagaatggtaacagagggctcacagaggggctgtgggtcccggaatctctctcaagaccctccagcagcccatgcctctcccaatcctatagtcctcccatccccgccgcttcctctctctgtttccccgtatcccactaacccccacctctcctccatgtcttcccagtgtctctcacggtcccacagccctcccgtcccctccccaactcttcttccctgcccccccactccatgtcccatggctctccactgctttcccctgaaaagcccctctggcctcagagtccgccataacttcccatctccacactcacagctccagtgccgcgtccagccccctccttccatgggcggtgctgacacaaggccaggacacgtgagggagagccctgcggccgtcccctccccggggtgtgggcggctaatgggaagcacatggctggggtgaccacaggagccagccggtcctcccgtctctcatgtctgcctcgctccccaggggcccacggccaagcaggaccaggtgactcagtgggtgggagcccagtcatgccaggagggtgttcacacccaggccttggaggtaggaggagggagtccaggatgaacacagcccctctctcctccccagagaggccaggaagctcctgcaggaagagctgcatctgcattagcagacctagtcccactctggagaacagctctcctctcaaggcccggaaacgccttccctctggccgccaccacacctgaagttccccaagtagcccctacttggaggagccatggaaggggctgggaacagactccttgacctgtacagttgctccctggaggagccggtccctcgccttctgggagcttcagcccagaggtggggcaggaacccccagcacggcagctcctgagaccccaccaggtcctcctgcctctgcatcccctcacggggaccaccagacatgaacccagatttggcacacacgcactcatttgtttattcactgagccgctgctccaggagccagcccccaagccaggtggacacagtacaactgcaaacacaagagcaggggccctgtctcctagagctcccggactgccctgacccccaaaggccagctcctcccttgcaccagcagtctctctgtcccctgtgagcccctacctctccgggtctcagctttcagtcttagggaaaaaaaaaaaaatctgtgttcatgggctcaggcttcctgcctttagccattcagagggttggggatgaaagacctttcacattaaaaaaaaaaaaaaaaaagtaaaagtagtgggctcggacttcaaaaaataagaaaacaacgtctcccaagaatgttccaggggaaaaatgaaagatagcttttcagattttttttttcctcgcagaaacattgcagagttgtttcctttgcttttgagtttggagtggggtcaggggagatgggaagcttgttaccagaaatataaaaggtattttcccccagtaagggaaaaaaaaaaaggcagaagagatcccaaaacactggtttcttcagccatctctgtggtgagaactgaaaatgtgtgtgaaatgttttgtgaagaggctcacagtgaaatactcaggggaaaagacccttgaacttgtcctctctgaccttgtccggggaatgacattgctcactggaaaaatgtttccctggggagacgagggtggccacttcctttggctgtctctaccgtggggattccaaaatgaacctcaggttccttgcggtggctgttttccactgcagggaatgtaggaaacagagaccagaataaaatggggttggcaggggcagggggagagaggacaggcagggtgcagcaagcctgtgtaccttcgcggcagactccacagtcagagctcagccagtggtgactgagagactgtccctgtctggggcgctgggatccaggaggcctcagtcccaggtacgacctgcgcagagctcaggaccctgctagaagcagtactcacattcttttttttttttttttttttttttttttttgagacggggtctcattctgtcgccaggggaaagagggaagaggaaaggcctgttttccggggccctggcaaaacccaggcgggagggaaacgcgttccacagggagctgggctattctcaaagtgcttctatggggaggagcctgagggatcctagtttccccttctgctcttcttacaaatagagcaacttggctcactgcaacctccgacactcccaggttcaagcgattctcctgcctcagcctcccgagtagctgggattacaggcacctgccaccacgcccggctaattttttttgtatttttagtagagacggggtttcaccgtgttggccaggatggtctcaatctcctgacctcgtgatccgcccgccccggcctcccaaagtgctgggattacaggcgtgagccaccgcgcccagccagtattcacattcttaagctagcttttcagtttcctaatcaaagtgggtgcttaaactcacagatccctacaagtcccagctggaagggtcttagcagctgcccagatccctcagttcactgttgagaaaaaaaaaaaaaaaaataggcccgtagaggaaaagaaacttgcccaagatcacagagcaaatacacagcagaagccaagcctggaacccaggttccctcttctcagttcctaccctggtgtgctgttccagtgcttggtgggaattagcctgatgcagtgggaggaccgtgggttgccagtgctgtgtccttgaccttgccacttctttgaccctctgcttcctcttgattacaatgaggataatagtactgcctcaaagagctattctgaggtttatgagagatcctccacacccaatgcttagaatagagcgtagcacgtaggaaatgccccataaaatacggcgcttcttagtatccttatccttatgagccgggcttatcacaagggcgtcttattcctccactaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtgagaacggcaggatacagttgtcaggtggctcgtcagagcttgcactatcagagagggcttcctggaggaagacctagttagctgttccctgttggatgaaaggagttggccaggtaaggagtgggtagagggattacataagaacctggaggagagagaaaacctaatatgtccagagcgtgggaacaggggagacaagacggtgagtctgatggggtggcgtgggtgaatgcaggccgccgactcctgcagtggagcagagagggtgacgcggccagctgttccgcagatgcgccaaggcctgacagacaccccttccagatctcccatagcttcccatgcccagggaatcacgtggagcattggcctgtgtgaccttgggcaagtcccctcccatctctgggcctcagttgctctatttgtaaaaacagcagaaggggaaactcggatccctcaggttcctcccgatagaagcactttgagaacagcccagctccctgtggaatgcttttccctcccgcctgtgttttgccagggcctcggaaaacaggcctttcctcttccctctttcctctgaaccctgggtcaactccagcccgcgtcatatttttgtcatgatcaagcccccacctttactgtttctgctttgtggaaagcagccttgacctggggccaaaggagaggtggccagccccgaccctgggagggggccagggtgagaaaggagggggcggagagcggctccccaaagaaaagcacagaaaaggtcggcagaggctccctggcccttgtcgcattgctgtcatccagcaaacgtgggccgaattgaactacctccagggagtggtttagactgaaccgaagggaactgatgtcgctgccggccagtcccagctggaggtgatttgcatggaggacatcgccatctggtggtcacttctgtcctgagccctgagcccccacttctgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggtaagaccctcacgatcaaaggagactttatagccatgagaaatgccaggctgtctggaaatggggagcccctggatccaaaggggatacccccaggaagaaaccaccttggggagaaggaatgggggtgtggacgaaggccagacattggggagagctttcacagcctgccccagtaagtgaattgaggaggctttcagaggccccttcccttcttcaccatcctggggagaacaatcttgtctcaaatggcctttgggcactgtgggcagagatgatcgactgctgtcccttctgtgccctcggtgctgggcctgagcaggatgtgtgtgcgtgcgtgtgcgagagcatatggacacacaagccctctgtgtgctcccagggaaccagtcaatggacgctattgtgtctcccattttccccaacctcgatgagctcccacgtcgctcctcccctccacagttcccaccatggattaccagactgctctccaaagaatttgccagctccccagctttatgtaaaagcaagtccccaaacttccacctcccaccccagatttccccacagaaagtaatctatgataacaaacatcagaatcgtagttattatactgacggggctgctggctgggaaggggcacggggcaggctttatcgcagagaatgccctctgttttgatctgggcagtggttacaccgacgtatacacatatagaacttcactacactgtatactccagaactgtacactttatgtgtaagagtctcttctcaatgataaaaagatcttcataaatgctgccctctcacccaggaagtaaagggctgtggtgataccaacaggcttcttttctcttctgctctaggctccacagattaaatcagcgaaatccccagggcaagcccagctggggcctcagctaggccagccccagccacgcccacctccgcaaggtatgacccaggacgagccactgcaagaaagcatgcagtgagggtgctgaaatgcaccgagggatccacatgtgattcccacaaggggctctgggaaaatgcacctgaatactttatccacagaatgaatgagactatggggttggtcaaactctttaaaaagtcaagaaaggagaagggaaatagaaggttaatttattaagaacctaatatgcaccaagcactgtgccagggaatgtcccacctattttctcacttttattttcccagccgtcctgcagtgaaaatgtcattatttccttttttttttttttcttttgagacagagtcttgctctgtcgccaggctggagtgcagtggtgcgatctcggctcactgcatcctccacctcccaggttcaagtgattctcctgcctcagcctcctgagtagctgggattacaggtgcacaccgccacgcccagctaatttttgtagtattagtagagatggggtttcaccatgttggccaggctggtctcaaattcctgacctcaggtgatccgcccacctcagcctcccaaagtgctgggattacaggcgtgagcctttctactgcgaggtaaaagttgaggctttgcccaaggaggcagaaaatggtagatttacaagtctggcctttcagacctttcaaacctaggaagtgtttattcatttcaatgagtggtgcctgatgatagatttgtgagtcgaccagctagagtaagaaagatagaaaaagggaagatcatctataaaaccttggccattgaaattcctcctcaaatatattccagcattactacattccaccacttattagagaatggacaaactattgtaaaaagatgaaaagcaatcagggcaatggctaactaactttctcaaagaatatcagctgctctgatattcttgcatgcagtcttgagagaaatccgccccgtatcctctcttgcaatcaaaacctcctgggcacactcgctctggcaccagcatggagcttcagagcacctgtgcaccaagaaaccaaagcaggcagtctcgctgcaatcttttaaggatcttcttaaaaacctatcagaggccgggcgcggtagctcaggcctgtaatcccagcactttgggaggccgaggcgggcggatcacgaggtcaggagttcgagaccagcctagccaatatggtgaaaccccatcagtactaaaaatacaaaaaaactagccagatgtggtggtggtgtgcacctgtaatcccagctactcgggaggctgaggcaggagaatcgcttgaacccaggaggcggaggttgcagtgagccgagattgcgccactgcactccaccctgggcgatagagggagattccatctcaaaaaaacaaaataaaataaataaattatatatatatatcagaaagaaggcattactatcatgttgtggccttcccagtcactattattaaaagcaacagattcattactttgtgaaaaaaagtcaaccttggccaccaaatggcttcctcttccacaggtcttagataaaatgtcccattcatttttcttgtttgtgtttctccttctggaaaagcaggagatatttttaagaaaagggaaattgtataattgtacacaactgtgtacagacatacctcagagatattgctggttcggttcaagaccaccccagtatatagtaaatatcagaataaagggagtcacacaaattttttggtgcatataaaagctatgtttacactacactgtagtctcttaagtacaatagcattatgtctgaaaaaaacaaagtacataccttaatgataaaatactttattactaacaatcgtctgagccctaggtgaatagtaacctttctgctgatggagggtcttgcctcaatactgatggctgcttactgatcagggtactggttgttgaagcaaggggtgactgaggcaatttataaaaataaggcaacagtgaagttagctgcatgcattgactcaccctttcacacaagatttctctgcagtacgtgatgctgtgtgatagcattttacccatagtagaacttctttcaaacttgaagtcagtcctcgcaaaacctgctgctgctttatcaactaagtttacgtaatattctaaatccttttgttgtcttttcatcaatcttcatagcatttttttttttttttttgagacggagtctccttgtcgcccaggctggagtgctatggcgtgatctccgctcactgcaaactccgctttcccgggttcatgccattctcctgcctcagcctcccgagtagctgggactacaggtgcccaccaacactcccggctaattttttgtatattttttagtagagacggggtttcaccgtgtttgccaggctggtctcgatctcccgacctcgtgatccgcccgcctcagcctcccaaagtgctgggattacaggcatgagccactgcgcccggccccttcatagcatctttatcaggagtagattacatctcaagaagtcactttattagcttatccataagaagcagctcctcatcaattcaagttttatcacgaggctgcagtaattccatcacatcttcaggcttcacttcttattttagttctcttgctatttccacgacatcttcacttacttcctccactgaagttttgaacccctcacagtcatccataaggatgggaatcaacttccaaactcctgttaatgttgctattttgatctcctcctatgaatcccaaatattattaatggcatctagaaaggtaaatcatttccagaaggttttcaatttcctttgccaagatccatcagaggaatcactgtctatggcaactatagctttatgaaaaaaattttttttttgagacagagtctcgctctatagcccaagctggagttcagtggtgcaatctcggctgaccgcaagctccacctcgcgggtcctggttcaagcagttctcctgcctcagcctctcaagtagctgggattacaggcacgcgccaccatgcccagctaatttttgtatttttagtagagatggagtttcaccatgttgtccaggctggtcttgaactccttaccttgtgagccacccgcctcggcctcccaaagtgctgggattacaggcatgagccactgcacctggccaaaatgtatttttaaaataatatgacctcagattttaaattactccttgatccatgaactaaaagacgtgatatgtattaaaaggcatgaaaacaaaattatcttgtacatctccatcagaactattgtgtggatagatgcattgtcaatgagcagtaatattttgaaaagaatcttttttctgaacactaggtctcaacagtaggcttaaaatattcaatgaaccatattggaaatactatgctgttatccaggctttgtttttccatttacacagcacaggcagagtagatttagcatcattcttaagggccctaggatttccagaatggttaatgagcactggcttcaactctaagtcaccggctgcactagccccaacaagagagtcagcctatcctttgaagctttgaagccaggcattgacttctcctctttagctatgaaagccctagatagtatcttcttccaatagaaggctgttccatctacactgaaaatctgttgtttagcacagccactttcatcaataatctaagctagttcttctggataacttgctgcagcttcttcgtcagcacttgcagcttcaccttgcagtttttgttatggagatggcttctttcctgagacttcacccaccaacctctgctagcttccaacttttcttctttagctttctcacctctctcagccttcataggattgaaagtagttagggccttgctctggattaggctttggcttaaggcaatgttgcgtctggtttgatcttctttccagaccactcaaatttttccgtatcagcaatgaggctgttttgatttcttatcatttgtgtgttcactggagtggcacatttaatttctttcaagaacttttccttcacattcacaacttagctaactttctggtgcaagaggcctaattttcagcttgtcttggctttcaacatgccctcctcactaagcttaatcatttctagtttttttatttaaaagtaagagatgtgtgactttccctttcacttgaatatttagaggccattattgggttcttaactggtccaatttcaatattgttgtgtctaggggaaagggaggcccaaggacaggaagagagatagggaaatggctggtaaatggggcagccagaacacacacatttatcaagtaagttcactgtctttttttgtttgtttgtttgtttgttttttgagatggagtctagctcttttgcccaggctggagtacagttgcacaatctcagctcactgcaacctctgcctcctgggctcaagcgattctcctgcctcagcctcccgggtagctgggactgcaggtgcatgccaccacacccagctaatttttttgtattttcagtagagaagggacgtcaccatgttggccatgatggtctcgatctgctgaccttgtgatccgcctgccttggcctcccaaagtgctgggattacaggcatgagccaccacgcccggccagttcactgtcttatatgggtgtggttcatggcacccaaaaacaattattaatacaatagtagtatcaaagatcactgattacggatcaccataacagatataataataatttaaaagtttgaaatttgtgacaattgtcaaatgtgaggcacagacaccacatgagtacatgctgttggaaggacagcattgacagacttgctcaatgcaaggtcgtcacaaccctccaatttagaaaaaacacagtatctgcaaactgaaataaaatggaccacaataaaacaaggtatgcctgtataaaatacacattagtattctccttcaggcagatctagtgtgtttgaatccagttccgtatctcactgcctttgcagtgttaggcaagtcatattacttctcggggcctcagtttcctcagtgtaaaggaggaaataacagcttccatgtttaaggatggggtgcttgtccatgagataaatgcaggtgaagcaattagcaaggcatcagacacagagatagtgcgtagaaggtgtcagttcttactactaataatttactacgaataactatgacataatgcttactattaataacgtgtgtcttatacatattgcttttcatgtttattattaacaatccttgtaactaatgcagtgccccgttacccagcaagaattctatagtaataagtgttccgaaactacatattcctcactctaccaggctcctggctgtgcctctgccccacaccctcctttcccctctgccctgggacctgctttttaaaagcacatttgaacagagccgttttaaaacagagagctactgtattctgatttcctctctggcccagagtaaaacatgcttgataaagagatattattttaagggaaatgaggctaaacacacttttagtgagttgaaaaacaatcaatttaaaaccaattaaggtaattaaagaaaatgcccagtgaattaacgctcagattaaaaataacaaggctaatgaaaaacaacgctttcattgagttccccaattaacaaatcacattattattttgaacttgctgttcatttcaactcagtaaaagtgaaattttcttttaataagcttcatgtctgtgcttaggcaaatactttctatatatgttaatattttgtgtatgtgctcatatgaaaaatactaaattgtttgctttgccaagaagccgaaagaaataactagggcagtggtaatggttagcactctggtctctgaatccagtaactagggtgtctctcttgataaatcccaggtatatgatagggactcaacaaagagttactgaattaatgaatgggtattcacattttctaagatatcaacctgggaagggaggcgaatcaggggaaactgaagataaaagtagaaaacaaatgttttatttgaactgcggtgggtttagaaaacccaaaagtaaccaacatttaaaaatcaggaggtgagctgggcgcggtgactcacacctgtaatcccagcactttgggaggctgaggtgggcgaatcacaaggtcaggagttcgagaccagcctggccaatatggggaaaccctgtctctactaaaaatacaaaaaattagctgggcgtggtggcggacgcctgtaatcccagctatttgagaggctgaggcaggagaatctcttaacccaggagacagaggaggttgcagtgagccgagatcgcgccactgcactctagcccggataatagtgcaagactccgtctcaaaaaaaaaaaaaaaaaaaatcaagaggtgttgcttaaacatctagatttccagcatctcttgatagcacagaagctctagaaacaatgggcctgtgtttctatacagcaactgtccctggcgttactaacagcggcttccttgatcagagcaagggctcctaggggctcctgcgtttgcctccagccctactcctcacttccatagtgacagagaggggcaattgctatgttctttatgcttgcacctcttcagagaaatagttctctggactgtttttatctcaagtgggcaaatttttgaaagcctcattacttttcttatatttgcctgctttatttatttacatacctggttggccctagaggtgtttgagataaatgtgacctcccatctactcgcctatacaatcatgaaagaggtaatgaatcaaagccatgtaatataatcagatgctaaactgatgctgcaatttaatccaatttagtgttccacaagctcacaaaaatgttcagatcgggagggatgtttgatgttcagtccaatgaccttattttacaaatgagggcccagaagcccagagaaggggagtgacttacccacggtcacacagcgagttaatggcaaggcttgagtcaggacctgaggctcctggtgccagtgtggagtcagggccaccagactccacaggtcatggaggttatacaggtggcatgtcctctgaaaatgtgctcagctgacgtgacatctggtaagggaggctggctgaaatctagtccttgcccctttggcatctggctcagagctgcttcagctgaaggaagccgccttttcttaattagcaataaagatgttatgaggactcaggcgagcctgcgtggtgtagttttcataaaggaaaaagtaataaaacagggtttttgagtcaaagagatctaggtttgaatctcggcgtgtccccttattcgtagtgacatcttaagcaagtcacaatatatctgggtctcagtttctctgtaaaaatggggccaagcacagtggctcacacctgtaatcccagcactttgggaggctaaggtgggagaattgcttgaggccaggagttcaagaccagcctgggcaacacagcgacaccccatctctacaaaaaaaaaaaggcagaaagaaaaagtggtgttgggcctgtagtcccagctactctagagactgaggcaggagggtggcttcagcccaggggttcactgctgcggtgtgaccatgccactgcactctaccctgggtgacagagaccccatctctttaattaaaaattatatatatacatacatacctatatacacgcacacacacactattaaaattatgttcacctatttctttttactttttaaaatgtgcctactagaaaatgtgtaattatacatgtggctctctctagagttccagggacagcactcccatggctgggggtaggggatgaaaataatgcctaacccacagagctgttgtgcccagtccaaagctggtgacataataggtgctcagtagaagccccattgttacagagtcacagagatgggttccagcaccttttagttttcagtctcctaacgtgcctacggtgctctcaaaaaaacgtggcaagaataaccccactctcccagcagcagcatgtcgtagggagaagagacctacgggcagccagtcggctttggcaaaatgcaattcaccatcaacagccctgacacccagaatttgagggttaggagagtgcaccttgattgttgggggccttggaattctactcaaagtcatttctgggtggctacaacatccccaagcttagatgcctcttggcttgcttgtggaagcctgtgtgccctgtacggtgagagggagaaaccaagattctctttgagctttctgtggctcctcttccaactgggaaaccttaataagactcagtctccacctctatgtggtgagaagaatggtatcttccctactgacctctctaggtcaagtgatatgttgcttttgaaagttcttggaaaagtttagagagcaactcaaaaagtaagagttaattcttgtcgttgtttccaaagaaatacatcttcagtgtggaaaatacccgtgagaaaaaaaaaaagagaattaaaatccttcttaatctcaccacttttgtaatgattatttagtgtctcattactcaacgtaggataagctgggaacccgttagaaatgcagaatcgcagatcctgcctatattagttttctcaggctgccttgataacaaaatgccatagactgggggggccttaaacaacagatgtttttttcacagttctggaggctgcaggtacaagatcaaggtgctagcagggttggtttctggtacagcttctctccttggcctgcagatggcagccttctttgtgtatcctcgtgtgtcctttcttctgtacctgggtacatgacactcctgatatttctttctcctcttataaggacaccaggcctatcagattagggccccaccgtatcacctcatttaactttaattacctctttaaagatcctatctccaaatagaattgcattgagggttagggttaaggtttcaacatatgaattgggacagggtgaacacaattcagtccgtaacgcagcccgagactcactctatcagaatctttattttgaccagatccccagtgattcatatgcacattaaagtctgaggcacactggttttagtgtacagtcttccagtcttgcttttttatatatgtttttacatatgtgccaaaataaaaccataagtactgtattctaagctattttgttcagcagtataatatttagcatatgttatcaacagtatcctgtgtcatttagtattactcagccacatcctatgtgatgaccacagcatattccattatacagatgtatcttaatgttcctaattacttccttatggttaggtatttatacggttttcagtttttcaccattataagaaacactgtaatgaacatccttgaagcaacattatttgtgtacagccatatctatcctaagaaaaaaaattgaactgaacctttttttttctggccccttaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaagtaagtgctttgggaattggaaaaggtataggatagagctggggtgtaggcagagcttggctgattcagggttagggacttggagacaaaggaagacccaacgaggccttgcctagacttcaaataggtaaaaacaggactagaggacagaatttgctggggaggcccaacaaggtgagagtatagattagacaccaccgtgaccctccgtgtatacacataccagccatttaccagctattgtttgctgcataacaaacaaccccaaaacttagtggctgaagaaaacaatcattctctttgttcataattttttggttcagctgtttgttctgagtttagctcagctgggaggttcttctgctggtgtctcctatagagttacagaataaaacataggatacccagttagattcacatttcagataaaaaacagataattgtgagtataattatgccccaaacattgcatggaatatacttacactaaaaaaaaagtcttagctttttatctgaaatgcacatttatctacacatttttattcgctaaatctggcaactctactttcctgggatcactcatacgactgcagtcatctggcagcttcactgaggctggatggtccaagaaggcctcacacacacatctggttgttggtgctagctgtcagctgggcctctttctctccatggggtctcatcctccccaaggctaagccgagctttcttacatggtagaactgcttttaaaaagggagaaagtacaagctgcaaggcctcttgaggcccagccttgggagttatgaaatgttattttatcacacgcttttagtcaaagcaagtcacagggccaaacccacattcaagaggtaggaaataaatttttggtaggaggagccatgaagtcacatctcaaaagggcaggctacagggacaagaggaatcattgcagtcatttttgtaagccatccatcacaatacacatatacatcctgtttcctctcaggcccatctcttggtttgtcctaaagagaggtcccaagtaactgatctttggaaagctctaccttctttcaaggccaaatgttgatcatcacagttcacagctaacagctattgtccacttactatgtgccaagcactttacttacttgggttttttttaagttctcacaagcttaggagttaataactatttcttatccccattgtacagacgagtaagcaaagaaaagattaaataacttgccaaagtttccagttaataactagaagagctgggattagacccacgacatccagtccagggatcatgctaacaactatttttttgaataggtaatatattcacatagttcaaagatctaaaaggtatcaggccaggtgtggtggctcatgcctgtaatcccaacactttgggaggccaaggtgggtggatcccacctgaggtcaggggtttgagaccagcctggccaacatggtgaaaccccatctctactaaaaatacaaaaattagctgggcgtgctggtgcacgcctgtagtcccagctactcaggaggctgaggcaggagaatcgcttgaacctgagaggctgaggttgcagtgagctgagatggcgccattgcactccagcctgggcaacaaagtgagactccatctcaataaataaataaataaataaataaataaataaatcaaagatgtatgttgaaaagcctcgttcccgccccattctcatccaacgctttgctacccccatccccagaaatgacttttgttagttcctatgtgtcctttcagtgcttccttatgcaaataaaaaatatttgcataaataaataataaaattgttcagatcctcgccctcattttctcacacacacaggagtattcactatcaacaccattctgctcactgcttttcatgtttaataataaatcctgggctggatgcgatggctcatgcctgtaatcccaacactttgggaggtggaggggggcggatcacaaggtcaggagatcgagaccatcctggctaacacagtgaaaccccatctctcctaaaaatacaaaaaattagccaggcgcggcagcgtgcgcctgtagtcccagctgctagggaggctgaggcaggagaatggcgtgaacccaggaggcggagcttgcagtgagctgagatcgtgccactgcactccagcctgggtgacagagcaagactccatctcgaaaaaaaaaaaaatcctggagcaccgagtttcttcgaattttattttttatggctgtatagtattccgctgtaccattgtactataatttatctaactaatccatcacaaatagaaacttggtttgatcttacaaataatgctgcaattaataaatctgaacatatactttcatagttgcaagactcactctagagaaaataacctgacatgatattgttagatcaaaggataaatgtatttttagtttgacagacactagcaaatggccctcctggcaatatggaatagcagttgacagcacagactctagagtcagactgcctgggttcaaatcctagctccaccacttaaaaactacacaacctcagataagttgcctaacctcgctgtgcttcaatttcctcacatgtggaatggggacaataaccgcacagggttattataaggattgcaatgagtttatgcacagttggtgcttagaatgctgctgccactacagaggcttatctgcatacagcctgtcaccacataaggagatcagccaactaatcacaggacagacaggggctctgggccttaaaccaggtttggtcactgaccttacagtgttctagctaaaaacacataaatttcctgacttactgctttaaagaacttggttcaattcaagtcagcaggtatttactgaatttacctactctgtgccttgttctagataagactctctgaggggtaataagcaaggagtaaaagacagtccctgcgttgaagtccccagtttttgttttgtttttttttttgagatggagtctcactgtcgcccaggctagagtgcagtggcgccatctcggctcactgcaagctccgcctcaaggattcatgccattctcctgcctcagcctcccgcgtagctgggactacaggcgcacgccacctcacccggctaattttttgtatttttagtagagacggggtttcaccgtgttagccaggatggtctcgatctcctgaccttgtggtccgcctgcctcggcctcccaaagtgctgggattacaggcgtgagccactgcgcccagcacagtgtggtgcagtttttaatgtgatgacagcatcacatgcagagctcttcaacttttgacacatttacataatctcttcctaggtctgttgcctcccctcctatgactgagcctcctgaggcagggcctgaatcatattcgtcttacacccctgtcccctagcacaggggaagtgctcagcaagcagttgctacaggctggcatttaggaagcactcagaatggcatctgccattcaaaaagatggcactaaaagaattccaaaagcgggtgggggacagaattagccataaagacattggagaagagatgggaattgaagtccagaatgtcagagctggaagaggcctgagggtcagcaggacaaacccttcgctctacagatgaggcaaaggaagccctgagaaggtaagttccttgcccaaggctacacacatcaaagagcagagaaggttctagaatacaggcctcctgatacctaaacgagtgctggaaataactataacctgatgttgatacagcacattgcagtttacaaagtgggtttgtacccataggcaggagagcagccaagctactctccagcaatgcctgctgcctcaacagtctggtataatggaaagaatgtggcctctgggtgctcccccattacttgctgtgaggaccggagcaagttacttgactctgtgaacccctatttctgaacctaagaaatggggaaaataaccaccttgcaaattatgtgtgtaatgtacctgacatcatgtaagcattggaatgcctggtttctggtcttcataaccttatgatgattggggtagcccatctggcttacaggcaagcccccaagacccatttctttgatagtcttcgccttgtcttcctcaacccccttgcctttctgtttcagcaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaa

SEQ ID NO: 40 - DNA, 153494 bp, Homo sapiens
aatgtttatgcatagaaatatagctgaggtggatgtggttgctgtcagctattcaggtttgctacctgatcacctcctgaagatgtagggtaaggacagaatccaagcctaaaagaaaaaacaaggagagaattgaaagttataggggtgggcagttatatttcttaaaaggctggtagaaatcattttcctaagaatgtgtttagagtacagatattcattttaatctttgatttctttaagttttttgatgtttgattttctaccagtatgacactcagcctctcaaaacaagaaggacattccccaaagttgaaatgaatctgtataagatttcattcaaatgcagaataaattcaaatgattcctaacccctcctcatctactttggagataaaaactgctatgattgttttaagtaaacagagaagtggagatgacaggaaatcatttttcatttgttaaaaatcagaaaacctttgacacacttttagataaatacacctactcctttgatcctttgtgtatgtattaccacagggcttaaatatcttaagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggtatgtatttgtgtttgatcctatatttcctttgttataacattctgcttttcatcactttgacagaatatttgtaaattttctggagagtgagtttgggtatatgctttgaggaatatgcttcctcattacaaaagatatggaaacataattgattactacacttgcttatcaatagtattttgattttgtttaaatgaaatgtttaagatacgtggattgctatgcattcatgttttagatttatcctctccaggcatgatttatgccattcaataattaaaataactaagttactttagaaaaagtgcctattaaacagagtactttgtttagaggacgtatatttaaataaacttatacagctaaagaaactgactttcacttcctcagtgacttaatttcactacatgctgatttgtcctttgcagtatttagctcagaccaagacagaattgtatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggtaaaggctgaccattggatatggtaattttaattaagtcctaatatatcatatgaatggaaatatggatttttgttagagaattatacatgaatagttcaataggtgttttcgtaaacctcttcactagttcttagaaagaagactcaataatttgagtttttaaaacttgagggacatactaaccagggagttcctgcatgcagactatttttaatacaagctgtcatattcttgggtggtgagaagtacagaaataatttcaaattcctaaaatattgttcggtgaaaggtttggagcttgtaaaacgttctgcgaataaaataactaatatgcttctaagatactacaataacctgaagctctgccttgtgaattgcttcattttcttttatgaacttggagtctaggtccagaattgtcacaactaagagaagcaggaagttttgtttggacttgatagaatatttggggtgttttctctccttagaattaagataagccctacagattatcttactgaagtctaaatattttaaaaatataagtagcagaggcagcactggtaacttttgtaatgtcacaataaagggcaaaatatcttaacattatagtgtgtacaatgcaagaagccatctgtctgcaacatttgtatatatgcagaacacctgtcttgaggtagaaagtgagaatgttcaatcagaaaggtcttgtgttgattttcatattaacaacatactataatcaggttattcttttgttcagagtaaagctaattagacaaaatgcttaagtagttgcaaggttaataaacataagagaaagtaagcagtttctattaaatggggaagttagtcatataatttttaaatgaagctgttagaacaatgtgcaaagttgatctggatttttgccaattcctatgaaaaataatccccagaaataaactactaaggaaaatacatcacaatgagttactgtgattttttgtttgtttgtctttttgacttagttctagaggaggaagacaattcacactggctaaagtatttcccttagtggtcatgccttttggaccacaatgctgatacctttctcaagcttctcaaatcagtgggaatcctcatcggaattcaatgtctattttgtctgtggacaagataatgataagctacataagtagagtgtagaatgagtcagccactgaagacacaatatacaaggtagccagaagtgaatatgattgagaattctcattagtgtgaggagacagtttgaagtccataaggttggaaattgcaaattaatcatttgtatataagtcagtttaattcagatctgctttgtgacaaggttaggagagaatgtggggcttaaaggtgatgtcgacaatgaaagccatttcttcttatggtaagtactggcatcattctaactggtatcacatggtagtagcctatttagaaatttgtgaatctctaatcacaaaaagaattgacttccttaaaaatatattatatcacctggaaagttctgaatatattttaagtcagcgatgatgcatttgtaaaacatatacttcctttctttagacaaaggatctttatgattctagaagctctacatttctgtggacttgtattttattttttattctagcattttatgttaaatatgataaatgaatttcaagcagcaatgtaagcaaatgctgaaggactgttgaaggaaaaagaaaatattaacaagatgtatctgtaactagatttgtttgcttagggtgtctttgcttctgagtgttagtttcctttaggtagctttatgccaagttctaataaattgattatttgtagtgccttagtcttataatttaattaattttgctcatcttggattaattttggccctagatattgaagtacatgttacttgtatttatatcataaccaatgatctatgaggattagatatgagctgagatatgaagtatttaaattatatacataatatgtttcattaagaataaagtgcacgagaaagaatatctggttcattcagcagtttttaaatgtctggtaacattgttatcttatagtctcaaaatctgtggtctgaagatattttctttaggcatgacatgctcatataacattttgaatgcacctttctctaaacttaccgagacatatctgtgctttgagaaatagctatgcagcaaaccaaaaaagtgaattgaaataattacatcaagacagtggaggggatattgcaaaaacaaaggggtttgtttgaatgcatcgaattgctctctactttcagactgaatccttagcatcatattatgctcctgttttttagtcaccagtatagatcctggaattgccaggtggagagaatgttaatcactgtccatggtcacagtagatcaatatttttaaatatctttacacgatttgcccaaagaaatgtcttttggcagttgtataacccccatttaatatacctttcaatgtgacaggtttagaagatttttgtatacgttttgtaataaactgatatatattaggatacaattgtaattgcgacattaaaatgttgaagcattagaagcattagtccaaaactgtctcattcaaggaatatatttataattatttatcagtcataaattcatacattttaaaagtaatatacattataattgttcctgttatctagcaaaagaaaatcatttctttttatccagataaagagggcaagtgtccactaataattatcccctctaaaaacaggccttttactacattctcacatttcacactacttcaagatgatacaattcttaaattagaaatccattatgaataacacacaaaatattaagattttgttaacaaaatcccttctgtaaacattggttttaagataattgcaaataaaatttgtttttagtttaagggaaacattcaaaatttttcacaagaaaacaattacgtcactttttatttcaaatattccagcgaattttctagagttttctggtatattatgggtaatgtttctatgaagaattgtaaagtgtaatatatgatctttttttctgcagctttttcattgaaaacaaattcacaaagcatatctacctagataagcctagtcatctctcactgatacccacacaagttaggaaataattccttgtggtagggacatttaaaagaactaactagttccaaattcagtgctggaactcttaataatggataagcattcttttacatttgtgttatccttggttgcttctttattatacactaaatacttgagataagatcaagaactctccctagggaaacagaaacaagagaagtggttttcatatacttagcagatttccttttaattgctaagatacaatactcattcagaacattctagtccattggatcatacactaaaaaaaaatagtttatccatgttgatatattttggtctagttgaaattgagaaacaacaagtgaggtaaaaaatttcaacatctttaaagaacaaaattgaacatcaatttctaaaagttttatggtcctatgaattgtgataaaatatgctttgacacgtaaatcagaaggcctagctatcatctaaatgttcagtgattcaagttgctttcagattatctcactactgttacatagacctagaaaaatcgagccactggtcaatagagggtgaaggaagagcatgtcaactcaccgaaattcaatgactcctcgtaattgtttaaattttatttgcccataaattcaatggaaaaatggaagactaacacatttatttttcagctttttgtatgtttctaaaactgcaagctaaagtcctcacaaaaagttctaacatagagagataaaaaaactatactctgcatttacatgtttttcttagtgttttgcttgttaatatctatgtaactttgatggaaatcccagcgttgctagcatcagatttgatttaatcatcaaagagcttttggacagaaaacaagtagatttgatgtgagtatgtgacagaatcaagaattctgcagcatttgcaagctttaactactcaatgcttctttaaaacaatttttaaatgggtgtaaagaagcttttggttaaaaatatggaactttattttctttgtttaaagaaagaagattaaggtttttagtcaaatcatgattctttaagccaatgtggcacatagctgtattaaaattgctattaaattctgccaaattaattaattgttaggattctgcagtcatattggactacttcatatatctggcctataggaatgatcaagctaacactcttcgatgactttgtttatattttgtttattttaaatttacttagatatgctgatgttgtaagaaattttggaaattgtcaaacaactggcattgtactaaattcaaaaatttcacagcaaagaactagctggtattaatgattcatcatttttttcactcccgtgtcatttaactttggtcacaacacttttttgtgtggagattcaaatttctctccaacactgaaattttcacgtaatcactaacagtgttctggaatgataagttaatctagcatataatcatgttgcatacacatgctgcagctatctgcttacccttagcattgttaagcactctgacaactgaatgccttaatctttaattatcattataattattgtcttcagccagaactatggataacttagtgttttagtgttttgtcatcatcgagaggtaggagagtatacacagctaatgtgatagaatgtgtatattgcaacaaacttatacatcttccaggataagaatacaaatatccctctaatagggaaattattttatttcagaaataattgtaatgcctgtgttatttgtctgatataatgtgggaagctgtagacagagatgttttgaattcagtggagcttctgattgaaactcagattaaaagtaatagagaggttgtataccaaaggtaggctagtagcttatctgagagggagcaggtaaatgagctgtaagcaatgaaggaaggctttaccaaggaggcgcatggccctccacgagattctacaggttagagaaatgcacaaaattaggattaaaatgaaaggtccagggaaataagggctaaaagtggtgtatctgaatcgcattttctgtgacttaccttcataaatatgcaattcaccacatgaattggtgcgtggtactggtgtttggtttctgggtctgagtaaatagtgtgactatggccaaagctctaaacctctctgtgcttcacagtttctacagttaaagttgtatagtaacactggtcccaactcaacaacttgctagttgtgtgactttggcaacttagttaattcctcattgcttcaactttctcatttatgaggtgggaataagacctaccttgcaggatcaaagcagaaacaaagcacttgacacatggatattattcacttaaaagaaaccacttttctttcacataaaaagttcagaaagagatttacttttcttacatttaaggatccccacctccatttaagaaaaaaaaatattttggtaatttggaatacagctctccttcattgctatcccataatgtttctgatggttaaaattggtgatgcttgactctttctgtgctatgaaatattgaaggccaagccaaggtagtaactaatctcagaagtgttcattgcataaggaacatgatgcttaacaaggccataatcttctgccagtttgtaagggaagaaatggtctaattcagttgtctaaaatgttaacatatgggtattatttctctagaacattttagttgtgtaatttctaccatttaaatggggtgaataaataaccaaatcattgaataggaaacaactggaatgaatccatgaaggaaaaacctaaaatcctgcactagtggatgggagctgggactaacaacatatttgaggtgacatgagagaaacatttttctattctgcaacaaagcaaatggagctttggcctcaccaaggggtccttggcactaccacagaaggcttcagcttcctgtctccaagcactgagtgagctgtttggacagggccgctgatctggcctctgatcctaaagtatctgcattacttttgctgaaatgagtcagcactgtgcctctgtgaacatggccagaggagggaaagacttctctcgtaactgaggtttaaacaattggttcccctatcaaaaaattgagagccacagatagtattcaacacaggagaaggtgagttatacaaagcagtaaatccatcagataattgcattttatttcctattataaaacagatgtcagcattcttctggggaatagcctaatcaactatttatccaataaaatttatcagaaggtgtcagagaataaatttatatttctttgctatccaaatatttgttggaaaacaaacaaaaacaaggaaagtgtagatatattttgttcctatatggatacatatatattgctagagtcgacatgcttacgcacaagtcatttaactaacttacgttaaatacacaaacaaaaggcctatttcccagtccatttttcattgtccttagcagttcttggctagtatagtgcttgcatgtggcagatatttaatcaaagtttgttgaattaaaaattgacctttctactgatactcagaatttaaaacctactctaaataaggttttaattgtattttttccctgaagtttcagcttaagcagatttgatattcatttttttgagaggacaaaaacctgcccttatatgtagaattgtaactgcactagctattattttggttcttacaaaatagtttcttcctcagatctcagacaatgactagggattttatgggaataacaaggctcctaaaagttcaatctgcttaaactgactacaaacattacttttccatataagtgggagggaattcattaacactcagttaatatggtcttggaagaaagaatgaggcaaaagcacgtttacaaatatttccaaatcattgttacacagagctaaaggcaacccatctttactggatgtgtgcctttggagagattaaccatggtgaaggacacccagcatgtgcggaaggaattcactcctccaaagaactaagcaagtaggcagtgctgaattagaaggcaggggtgagggacaaagggagaagagaatattaacaaattcaagactttcagacccccctcctgctttaagcagaacaggtgccaccaagctataggaagctcttctcttcctgctactttggaaaaatgataggaataaccagagttaaatagaaaatcatttaatccaactggaccattgagaactgaattcacgttttacccgatctataaaaataatcttgtttgaaaggaaggggtccagatgattacaaatgaaatgagtttgctttcttaatttgtttccaacattttaagaaatgctaagtgtaatgttgatggaatgaacttccattcacccatccactttaaacacacacagacacacaaacaaaaaacaaaaccttataccttaacttagaagaggaacacgttatcttctctgagactgtggcaggctttaggaacatgtagaaagcaatagattttgacaccgttgatattctcatcaggaagccagcaaaatacattcgagaacacattgtttcaaagtaagggaacttccatggaagccaagttaagtagccagctgagttcttgggtgacggctaacaaggcttgtctttgcatcagatatcattaccatcactcatttattcattcttatttttcaagtatttattgaagttttctatgtattgtgtctcaggctaaatacttgggaaaacttgatgtgtaggattttataggcacttggatgagatgaatgcattttaacttttctgaacaatgaattgagtaattgagagtttcacaaaaatccaaagtgataggtagacaatatcttggatgataaagtaatatgaattaattccaacaaattagaaaaatctttctttaccaataaagttaattaggtaatccctagagcgtacactttgagggtagaaaaatattgtttccagaaaacaaacatggaagagtgagcaccactgagaagctttggtggagaggaaagttctgttggtgggaataggccacaaagtaaaaccaacatttaggttgctctccaacaagaaaaaacaccatcaaccaagacaaatgtatatgaaattagtatgagccagtcatattctctttttcactcccattaaatcatacatttactgtattagttactagggctgcaagtaaatggttgaaattacattgggattgtgaactgaatccacagtttaaggtacctgatcagagtaaagtatagaaaatacatgaaccagcctacgtatttagaattaaaaattaggtttatcaaaagacaagttattctttgaatttgttgtgagattccacatttgtgtgtttgagaaaggaaacaggaaaattatttcagaaaaaaatgataaaatattataaaatctgttaatccttaataaattaaaaatagtgcctgtgatcagaggaagatgaaatttaaatggttctgtaggaaaaccacagaggaataaaagatttgatctgtaggtcatctgaaggataatctttttttaaagaaaaagatgcattattttttcattggcagcaaaaacaatttagatatttggaggcagagagatgtctggagaaatatatattgcctctgacctgcctcttgttcaaataccttgctctgaaatactgagaaagaacctactttttgaaattacctgtaagcgacaggattatgccagataatatctaagatctcttccagtttataatttccattatttaatgacacttttttgtataatattcatgcatccatttttattggcttgttcataaatgttaactatgctttgttctttagcgctgaaagtaagcactaatgctacccaacaggagtgaaatttttagaaggtgctcttatcaagaatagttggttaagaaaagaaaatctgggttcccagacctgggctcagatccaactctgcaacttagtagaaagtttcttaagctttctaaacctcagctgtttcatttctaaaaggggattgttctaagaattaaatataaacttcttacctcatttcttggtactcatttttttctggtgatcatagttttggagtttcttatgtccttatcactattttttcttgattgcataggcctcacataattaaagcatccccataaaacccctcccagtgttgagaatgttttcatgatgtggcagttatcttggatattttgttcaggcataattggaatccgttttcaacacagctatactctatatgatgaatgcttccacatcaatggttctgtgaggagaggccatctgtgaacacagagtgcaggtcattgtttctagaaggcactccttgcacagacagcaggatttgaccttttataagcttggatgggcagtagagactttgaaaaagagatgtgggtattcataggtgattcagaattctatgtgtacacaagattccatgcagtattttataatctactaatgtgactcagctttgggtaagattgtagttctggtggtgattcacagaggtctcctagatttgtctagtaatactgtagagagtttagtcttagcatccttccaggagcaatttgggactgttatctaagaactaagaatgatttcaaataaaattacagtaaacttgtgacttgttcactttgcagataaaaccaatggttatatccagcagaaggccatttgtataataaaagatttgcccaaaggatctagcaagagaagagagctctaaaatcaatttttctaaaaatcactgaaaacattacctcattgttttgatctagctgtgaaaatagactgttttttatgttttaagaaaggatgaggagatatcacttgtttcatcatttattgattggatccttaggcttaagcagggatcaaacagtttgcactgttagccaaggcatttacagcattgagacagaagcagacctacaaacttgaatgggcttatatattttactgggtaaatttacctaatatattgaattgacagctaaaatgtaggtattcctgatgaggtacatcgataaatggtaaagaagatctacatgaaaggagtgtgatgtttttctgaacttgttagggaagctaccatgtggccatttgtggaggaaatctgtacttatttctgtattgattaggtcatttgtgccatttgttctgctctgcgggaattacttcacttggcttgctctttctgcactctgaattaccttgtttctccaggcaaaaattcttatctgtatagaaatccaagatttctgtagccttgtgagtattatttgctgaaggcgcagggacagtgataagtgaaaagtcagtattcttctactgattttgagtttacctttggattatgtttgatcaaaagctacatgtggcattgtgatttcaaataaataatttgttttattgtcttgtactgtaaatgttacctgatatttataaactccctcctgtgtgaaagggactttgtgtgcctatgtaatgtccatacctatctactttttggctgtagtcatagcagtgacattatctctgttatgatatatttagggattcttgttgaaggaagaatgaaagaagttatttcatccttaatttttttctttgtaatatgaattaccctgtaatatgtaacggccacacaaaacagagaattcaattatctcatctgggtatcatctaactaagaatcaggagctaagggaagtaggtatagtgaagccatgacaaagaaggccatggaaattaatttttgaaactgccgcaaagtacacggaaatttgtctgcatgcttcacagatctatacttgtggttgccgtttatggcacgaatgatgccacggactatcagctcctgattttacatatctttgggacacactctcccccggtgtcataggaagggggtaggtttgacatcatggtgatctaaatttgaattccatctctgcctcttactcacctagcaaagttaattaaccattgtgagtttaatattttcttcatgagttacgtataaaatacttgccacataatagaaatgatagcttgttcctgctttctctacatgtactgactatccattaaaacattgaaacttctaagaatatgtacactgaaattgtatgtatatcaatatttgttttgaaaatactgtaaagttgtggtttgagtcacaaatattgtatcagtccatgaataactggaaaagaaaagtaaaataaatttggagggttgtcacattctatagcattggcttttataaagtgtcaacaagatatataattaagtaaaaaaataaggaaaaaatactacggcatatctaaatccatatttgcactcaccacccatcttaatttgaagcagtgaggtttctttaggggacccagtgattcacacttaagaacaaacagatgcctaggaataagtgattaagagaaaatattattttttcagaaaataaatggtgataaaatagatgaaaaatggttttaaagatgcatattaagtgatgagtgaagtttaaaggaaaattgcattttcattttttttcctaatggattcacatggtttgagcttttaagtgcatgttttaagttactcttttgtgattgtttacagttaaggcatattaccttgctcttcaaatacgtgctctaagatattcctctgtaaactcagggaaaggcactacattatttatttacaacctgtcttctgccccatgggggagaagtaacaccagatagacaaaggtatggaatttaccgatattgagcatgaaattatcctttctaactaatacgtttctcctgcaattatcttctgaaaaacttatataagaattagcccatgtgagctttcttcgcagattgtttgtcctcaatttgttttctgccaagcaaaccaaacacctggaatgcacacgctcattccttgactgtgctttcagtgtttgttggcagagggtgacggttgcttttagcagatgtgcaggatcagggtggcctttttatctttctaccctcaaggagtcagtttctcagataaaggaagtggtgaggataacggatgtttcagccttaccattaaataaaagttaagcatagtaggtataataaacatgtttattaattatttgtcaaaggtagtgactttgttaaaacatttggaaagagaaatttaaagacaatgcttaatttttattaaatattaaatcttattttatgacctgaagtaaactaacaaccaaaataattttctttgttttcccatttacctaacttgatgaaatggaaaatcttagaaataatatttataggtaaatataaggatttattttatatcaatatattttacattatgtacataaaacatattgctacaaacttcttaacctaattcatcatatgcattagctaggtttactccggtaagttttaacccatgacaaggaaataaactttattttacttttgagaaatatttctgcagagataacagaaaataaatgtgcatactctttgataaatatatatgtgtgtatattgatatctacatttatatatgtatatatttgagatttcttattataaaaagaataatctttattattatgactgatggggtgctccaggctagcttattttctactttttttctttctgaattcacttttttcattgctaataaacaatatcccattaaggctaggataatagaagagaatcaatgaagagtggaaacttgcctgtacccctcttctctgcacgtcacagctgatgaaatggcaagatagtaatagagagtaagatgatgaatttattgtttcaaatgaggactcaggggtttctgtacactttagattttgatttcatagctctgccccagtgactaaaatgagctgtactgtatgtcttttaaatgccaattggtgattcagggcccatattttaacacaaatgagccatcctattccttaagtgaataccattacagaaggaagtaaatgtgagttttcttatgtcacctcaaggggaaatctcagatggtggccctccttctttatcacataggagagttatttctgaagcagtagttctcaaaacatcatatacatgagaatcacctgaaggtttattgaaatacagaatttttggattcagcaggtctgtgatggggcccaagtatatgcatttctaacaagttcttagtgatgttgatgttgccagtacatgaaccagaatttgacaactactgatctaaaacataaaactttttgccagaatgtagaatttgcatgattgagattttataatctaaaaacaaaggaatattataaaatttcaaaacaaactaatcttagaataactttgaatttactttcatttaaaaattatttttaaaacatatttttaaaggagtagatgaggatagtagattccactagacagagttacgcagtctctgttttgaatgactattgaatacaaatttctctctaagattgtgtgtactaagagtttccagtgtaggattacaaaatccactgagatataataataatcccctaatccacaagactggatattctaaaaatcaaggaaaattttaaaataaaaattggtgagcattagaggttaaaactgtcaacacaaaaatgtgaagacaaagatttataacagctttattttaattgccccaaattaggaacagctcaaatgtcctttagaaggtggataaactgcagtacatccatagagtggaatattgctcagcagtaaaaaggagtgaattactaatcgacacaatagtttggatgggtctcaagggaattattctgagtgaaagaagccaatctcaagtcattgcagactgtatgatcccatttatatcacatgtcaaaatgataaaactatcatgacaaagggcagattggtgactgctaggagatatgacaaagggaggggtgtcactgtaaaggggtcgtatgaggaagttaaaaaactggaactgttctgtagcctgatagtgatggtggttatataaatttatacaagtgttaaaattaataaaaccatacagcccctaaaaaagtcaaatttactgtataatagttttaaaattaaaaaaggcagaattacactaccatttagttacatcaagtaactgaatttgcagttgtatgaggtaaaagtatcaatttatataaataaaatatgctttatttcaaacaaaatagataagaagatatgatctctatgagaatcattcttcaaaaatggtactaattccattttttccaggcagagatcctaggcaaattttggaatttggaaaaatctgactgacatagtccttaactgtgttacccctggtacccttcccctattttctcattcggtatttttcttagaatcctttcctgtaaactttgctgctttaaaaatgattttcatggacacgtttattcctctcatttagactaactgtgaaaaactgacagcctagaactttcatccagttacctcccacatatatgtacacgccctcagaaattgccatccattcacaacttaaagagcccagtggcttctgaaggaagcccataccattctgaagtagctataatttttaaagacactaaggtctctagaaatgtctggaagatcaggtctccagaagaattggcagtttaattctagccagggatctgatcaggtgatatcaataaacatctgttgaaaaaatgcatatgtttctctcagtgaacgagttaatagctaatacacttataatggcaactctgtgtgaagtacttttctgagtactttatgtatattaatgtgcttaatcctctcagccacttttgaggtagggacccttattatttgcattttcagatgagaaaactgaggcacaaacacatttggtaactttctcagagtcagtggtggagtcagtcttcaagcccttgatgtccagcttcagagtccatgcagatagtctcagttgacttagtcctaaaggcagctgtgggttgaggttccaacagcctctggtctgcttcattcctcaaagtaatctccaagcccgaatcctagcatggtggtagaggtgaggctccataaaccttagaaatagctctcccagatatgacaacatttgggccttggaccagtggtcgtgcatccactctacagtaacaggggcttctatagttaatttgattctcagttttaagattactagagaatcaaatgttgagtatgcacttttgtatgttagtgggatatctgaagcaacattactgataaaaagtaattgcacatttctggatagtgataactggaataatactctcttgtgataaaagatacagtttttacatggtttggcatctttctttaatcagtacccatgattatataggtgagtcttgcattcccttcttggtgaacacattccagactcatagattgggcatggtgatggcaggcagtggaaaaagcatgggtttttgagaactgtgtttgaataatttttatgcagtttgactttgggcagggaattttatcctttctgaaccgttttctttctttctctttctttcttcttccctccatgagtgaatgattcgttgtagtgaggattaaaaacactatgtgtaaagtgttctttttggcattttgtacatgaaataatgtatgaaaacatgatacctattatctgcttgctatgagttaagatatctgtatttaagtggaattaaatatgaacaactctgggagtttgtgatgatcgttatccaggtaccaatttttagatttactttcaaaatctaaaaatgatatgcaatatcaatttctcttggttacaaagactggtgccaaggtttttctcctgatgacatacccataagccttgtgaggaaataaagtaatttaaatatgagcttaatgccagcacagccatagaagtaaatacatgtctataaaatgaagcacttaattcctttaagtagctgccttttaggttcttttctgaactgacccctttttggcccccaggctctgatgtgtaaggctggacctgtgctgtgctgaatttcaggagagagtgtacaaatgttactcacagtgtgagtagtgagagatggagtgcaggccaatcttctgcagctgggaagagcaattagcagcttcatgaattagggtcttgtttacactgttgtccaagataatcatttgtttgttttaactaagatgctctatcttcatcagaggcatcaatcctcatatttaaatgataaagtctttgaatttcacagataatgtttggatttcacagcgggaaccccacacagcacatattctctcttgctgactttgataatcaagacatgagctatgtatattgcaagtttttcttcaaatagatatgaaaacacgatgtcatctattcttgcaacattttttacacagacccattttaagaaatacttttaacattacgtcccagcacacatacatacatgcttgtgaatgcacacagagtccacaaacacttgtgttcttcatgtagacacagcacacaagctcagattttttggttaaatttatgccttcaaaacacattttaaaatatgataatatgaatataatataaatagttaatattttaagcaattgaaaaattaatacacctttctgggtttagatgattagaagacatttatagaagacatttacatttttagaaacatgcattcatttcctattgtattctagacatcttggcgggtcctagagacccagagataaacaaagcacaatccctgcccttggtgaacttacagcctgactctcatatcatttcaaggccctaggataagtgctggagtgcaggtgtgtagcctgatagagacatcaaggtgaacacagaggaggaacagatcatgaaaagtgggcggtagagagctaggagatttgttagtaaagggttgaatctcattttgttggttaatatacaagtttaaagcagtaattcatcacatgttgtaagatgagtttctcaaaaggagaaaacctttagagaataaaggtggctggtgtgttgttctgactgatggaggggcttcctgttttataccaaaagcactgtattgttcaggagcagctcagtcaaaagacattggtccacaatgacacctgggtgtgtaaagagtcacataagttcttgtaataaaaacatcagagagctgttttatgacaagagtcacaggtgtgcattgcaccatctgctggcatagggagagcatgagaggctttgccaagggacagatcaatgttctagccctgacaagccttcctggcatccttctcagggattctcagcttttggaccttgacttctttcccctttttgacatagagcaaagcaagaggtggtttaataaataatcatgaggtatcacttctaaattactgaaaaatcttttaaatatctgcatttacatggttctttccatttcctccaggagaacacagggggctggtctattcccaattctgaataaaacacaagatggtatctataaatgatcggcccagccaccagaggacctcttgctctcctgcatttctttgaatttgttcttagcctcagcttctgcctctgggccccatccttccagatgtgagcaggccaaactcttactctgcttccacccccttatccgcacatacaccataaaagtgcacctcactttttgccccttcaaactatccttgctattggctatagtctttgccctcgaaatctcttctgtgccatccttggagaaaggtctggaaaaggagagcaatacttgaactctcaaggaaagacagaggaaagttgcttctaactctcaagtgtgtgtaacaagaggttaagataatgactaacttcattctcaaagttcacttcttgggggataattatcagattcttgatgggtatttatcagtaaggagaatgactaacttttgactgaggattttgagtaaatgcttctattcttttttgtggggtactactctctttatcttactggatgggagatagttgtgggtttttttccctaaataatgaattagtctaatttaaccctttatcttgaaaattagtgaacaatcctataatgactcatttggaagtcactgcttagcatacttactgaaaaacaaagaaaatatgtagttggaaagctaaattgagtaactccttgtttttagcagattataaatttcttaaaggcaggtacagggctaaatctatctttgcatctcacaatttttagcagacttttttacacctagtaggagctgggtaaataatagtttatcaacttcactggcataacaaggcctaattacacacatgatcacatacacatggattacctgtacaattgaaactggaccctccaggagagcgagtgctttactttgaccaatttaaatacaaatctcagccttgtaaaacatcaaatacagaatataatttaatattctctcattgattcattgtcatagtatgaaaatcagttattgagctatatcgtgagaatggtgaatttgtgctgttaaaacttcacctcctccaggcatatccacaaggagaaatggcaaacaatgggacaaaaagaggaaaagagataaagtgactctgtcagtctttaccagtaaaagtcatggaatactgctcagcacatagaaacatgctgtaagtgttagttgctgctataattatttaggcagctcctttattagaatctttgaactgctagtatacattctctgcatggagtatagaaacttgaaaataaatacagcataaagaaatcagaacacttataaatttcttatgaccggctataaaattcaaaaaatcaacagtattcaattctcattgacctttttatgtcctgcctcatctctcaaaagagtacttttgtaggcaacaataatacatatttcctggagagagaatgaggcacagtggatgcctttgtatttattgtgttaccttgggcaagttccttgaccttactgaattttagttgttccatgtgtataaaggagacagtgacatacctgtttctggttgtgaggtaataaatgagatactttgtaaaagttttgaaacacttcatgggcactaactaatttgtaatcatagtatcttgaatgcctattatgtgtcaggcctggtgttagctattggtgattttaaaattaagtttgaggatataattttcggaggtgttcacaagtagacatactttggatttgagattagagaattatgtagcattatagtggcctctgagagttaaaggtcaaaataggatgagatttcaggtgtagaagataattcacaccattggaaagaatcatagtgtgtgtggtttatttttaagcattaaatatgtggtcccatataaaccaacttagcagtaccaattggcatacatgtgcgtactgtatgtagttttaatacttttataaatattgcaagatttggagcagtgatgaggtgccaggtattagagaggtgattaagaggagctaacaatggcttaaagcaaaatggtgattgttaacctgggttttatcactactgcaaagcattttcaacccttctgaaaggatgtcctgtgatgttgcaggtaggtttctggaaagcatactctgagatagagttaagtgtgcaggatgtttactaaggagagttcttgggaccaaccccacagagggacagggaggggagcaggactgggcagagagagaaggtgagctgcagttcaggccagaggatgaggacagcctctgctgatcctgcagaaagctctgccactggaatgaccttcagagagtcccacaaagggttgagatctcagggcttctagtaccctcttgatcatttattgaattattggatatggattattctaggaaagagtgtgcttgaggtagtgcagctctctgcagcagagacagttcaacaagaggcaacaagaccttgaagggagaattgtgcccaccaagtgaaatctaccagaagggtaaaaaaaattaacaaagattgcatattctcacttgtatctgggagctaaaaattttgatcacatggagacagagagtaaaaagatagataacagaggctgggaagggtgagtggcatagggaagaaaggatgaagagaagttgattaaagggtacaaacatacagcaagatagaaggaatagattcaatgtttgataacagagtagggtgactatatttaacaaaaagatactgtactcaggcgatggacaccctaaatactctgactttatcactatgtattgtatgcatgttgtagcatttctcatgtaccctataaatttgtacaaattaaaaaaaaataacaacagaaacttcatgatgcctagagcagacgtatctaaatgcttaccccagaattgaataaaaattgtgtattgctgctagggagaaaaggcttcactggatttgggtcagttttttcaaaaaagctgtgatctatacggtttttaaacccctaacattctccttggaaataacaatcaatcacctacaaatcagagtctctcccacctggactgaagcccagtctgggcgcatagttcttgcatctgacaatgatttaatccccagacaaatttttatactttgaactttttattatggaaattttttaaatgtgcacaaaatggagataattgtgtaacaaacccccatgtatgcatcatgaagcatcagcattttgcccttcttgttccagagaaatttttaatagcacaaagcacagcctcccgtgttgatcggagacagatctggagggatgtgtcctcggagcggggtgagatttcacaatgtttgaaggtaggaacatctcttaatagcactgacgtgagtgcagttgaagctgtcagagccacggttctgggaagtggcacgctcacccccacagtcctccggagtaatgctgggccatatactcgcatttccactgtcccagcttgcctgctgggccgtgggaattggatttggacctggaatgtgtgctgatgcctgaggctatcttaatgcttcatggcacccaagaaggccatacttggcatctcaaaaaaggtgcagggcatttaacatgtttgctttagttttgtaattatgctgtgtaaccgagggtcctcttggaaattgttgcaaatgaaagtgaactgtccagtcgtccgtgttcttggcaaattttcagcccactataaagcgaaaatcaaaatttctgtttaagaaaggagtatcttcaaaaaagcttgcagacaatatctaaagcaatgtttgaaatcttaatagaaccctgtgacttgaacacctaaactattttttaaagtttgattttgtttttaattgacacgtacatatttatggggtataatgtggtatttcaacacatgtattcattgtgtaatgatcgaatcagagtaattagcatatccatcacctcaaatatttgtcatttctttgtggtgagaacattaaaaatcctctcttctcgctatttggaaatatgcaatacaatattgttaactgtagttaccctatagagcaatttctagaacagaactttttcctcctgagtgtaactttgtacctgttgaccagactctctccatcatccctcccacgatccctagactctggtaactgctattctatcatttctgataccctgcaacttcaagtccccaggtggctctgccagagcgttcacgatgacgtcccattcctgttaagctatgcctctatcctcagtggaaacagcccgggcgttcctaggagtgaatcagcagtccgctttatcccttcgaattgagcaggaatttgttggttgtttggctccggagcaggtggcggcgggggctgtggcggttgcgtttcctctttgaggtgggggctcagctgtttccttggtcatgcgcccctggtaagtgcctggaggaggcagaaggccaagaatacagctgagacttggtctgctgccaactcccagcagctgctgctctgttctctgagctggaaccgactccaggctgctatgtggcctgatctggcattcagggaggggcttcagaggagtgtcacttgcatactctgagtgacttagcccacctgctattttgtgtgtgtgtaacctaattcaagtgagacttctccaacattcgaattacatgaaaaatgttaggtcactgaaagaaacaaacttttcgctcctttggaggccaatgaatttgcagatcttaaaggaatgattttaaaagttaaaagctgagtggaccaccctaactcagaatacatgagtttaatataagtgtgtcttggtttatatttatgtctgtctacatatgcacaaaagcaacttggaaagaatacaggactagaagaagaacagagtcttaggctttatgtggcctttatgtagataaatataaaggacaacagcattgcccttggcctaagcttttttttttaatatgataacaagatcataagcggcctaagctttttttaatatgataacaagatcataaaactctcatgaaattatgagagcttgtttttgaagtaaaaatttaaagtaagtggaaagttctgagcaaagtgctatacatggacactctaaaaatatctgcagaatcaaaatgtgtacttagataccacacacatacatccatgtatctagttctacattgaagtagttaataggtcttttcaaatgactttaacactgagttgttttgtatagtgaaaacattcatttggaggtaagaggttatatcaaacattcaggatttagtcatttcctatatttgagaaacaagaaaagaatcctctgggtaaatattgcatttgttcatgaaaccatcctcattttcaaaagcacagctgcagatgaagagctacttaatgaaccctattccattttgtaaaaagttaatacaacttccccctggagtctcctagagggcagggctgtactccagtcatcgttgtaatgcttgttctcatcaaggtatttagttagtgtatgcacaatatgtggaaggcagtaaaatgtatcctgctcattaatggttttttaaaggaaacgtgatagaatgtgtgcattgttgtggtttctaaaacacccagatcattgctcactgtatgatggctcaactgggctgtgcccatatcctcagaacctcaactccaaccttacggttcaaagaatagtggttggaagtaggagctgattaaaagtggcaaacctacttgggggatactcagtcaaggagattaataaatagtatatactgagaatgatacaaatgaataccgatgttgtcacttatacacccttccctgaatctaaacctaccaagcagaagggaatttaatttctttaaatggagttatagggtattcccacaaactgctatttttttctgaaaattttttactggtttcttgtagagggaagcaagcttagaacaaaatattccaatcagtggctccacacaaaaatatccctgaattcttaagaaattttagcccaagtcatattgcaaaattattcttgactttgttttcagtgattttgagttgttttgattttgacatttattccaagcacaaaacatattttatgataatttaaatgtctatttaattaatcttgacattcttttggcattattcaactagttttaaaatttttgttaaattatttggttgtgtgtaggtgtagggtttttattttagtttgtctttgacattaatttcaaacatacatttttatagactaaattccttttattgcacattttattaaatgtacttcttcttaattttagctttattaacaatttttccattatctttacttttctattttttgattaaatgggtaattatatttcaaccacaaacatgctttacagtgtgattaacactgcaaacaggcatccaaattaattcattattttctatctcttctcagtctttatgtttactttttccaaatataaaattaaacaggtttttttgagatttggaaaggttagaataaacatgcaacctcaactatcccctgtggttctacccacctgaattgccactggcatcactatggcatgccttcagtatttattgccagtcatgtagtaactattatcctcactcatttcaaaagcgtatggataaaattgaagtcccagaaccaatctgtcagaatttaggctctgcctcacccctagagtgaaatatttgatatgcttaatgtatctatgactcagcttcctccactctaaaatgtgactctttaagggctagtcctattatcctacattctttaatcaaaatactgtcaggcacagagtgagtctccaataagtatatttaaattgttttaaattgatactatttatattaacatttaacttaagttttattcaaaatctcaaactgtatcatagcaaaactagttttatttagcaatctgatttgtggtagtgataatgataatggtaaactaatttaagaatgaaaccacagtcattttgcattgtgattacgtgtcataatctcatgactagttaaatttatgtattaattcattaaataactaattcatcaagttattattgaattccaagcattctactagatgttttagtacaatattcctcattttaaaataacttatgtgagagagggttaagtcactttcagattcttctcaaagaagcagtaatctttttgcattgactcttggaagttggactctatttgtagcttcaatcacttcttaatatatttgaaagaggtgctagattaaaagaagagaaaaagatatgtaagagtccttctagttaattaaaaggaaatgtaatctagtcttaaattggatcataatgcatgacaagttaatttataatgaaattttgcaatggtattgatgcagtatcactccaaaatactgcactttggaagtcagtaagtcttgaagatcacctgcagtacttttattctcaaagaagaagaagaagaagaagaagaagaagaagaagaagaagaagaagaggaagaggaagaggaagaggaaggaggaggaggaggaggaggagaaggagaagaagaaaagaagaagaagaagaagaagaagaagaagaagaagaagaagaagaagaagaagaagaagaagaagaagaagaagaagaagaaggagaagaagaagaaagaagaaagtcataaagtaagtgagaacacaaatttccctctcaggaaattcacaatgtccctccctcagaaatttcttgctactattcatggtaaagtatcatctctgactttgttcttatccattttgggggaagagtattcctaaatatagaagtgtaaatttttggaagtgtatattttttaataaattaaaataaaatggaaacctaaaaaacagagcatttttagtatttggatgggcagcatttcttttcagttttgcagcatcaccttaagtgtggcatcttggtgagcctagtggattgccagtagagcaaatagccaatgtagtccactggctggcatgctatcttctccttgctcctgctggagtctctgaagtgtagagcaatcatggcctaatctggaattggcatctgggagtatgcccaagccccatatgagtggtcaggccacagagttgccagcagagagctagtgctcccaaaactgaaaacgaagtctaccaggatatgaggatagttttgaaccacacaggattttagatacctgggatctgccgtttttacatttgcaaattgccaagattcaaattacacaaattatctatgcacacacataaatatttaaaattatgatactaataatgccttgtgagactgactaaaagtagtcatttatgtaaatatgcttagacttctttggtacttggagattcaagttacttctctcgtcatcatgcatgttttgagatgcaacaggatctcattttgttctttactttctttatatcttatttccactgaaaatatgtaatctttgaggcatagaacacatttttctatttagcagactttatcaaatacggggaaatgctattcttaatataatacttaactataattatgaacagtcctctctgctaggtgctagcaataaagaataaatgaccccttttgttttcacagttttacatttatttttgctgcagccttcatcatattaatacattcctccaaatatttcatattctactttcatatatttgcaggagagtttttgacagttgggtcttccttctttccttctttccttccttccctccttctttccttcctaattataattatgagcaaagaaaggtaataatttctcccactacataagatttttcccaaatattaggccttagactttattaaggagactactcaacaaaaagattccacttctgaaagtaccttgctatatgttacaaatgcaactactggcttctcctttcttatctactttaaaatcttgaaggtttcacaaataagcccacagctcagaagctgagtattttatattacataagattgacagatagttcatttctgtgatatatcaaattgtaaatttgattcttttttggataattttatcctagcaatttccacatccatagtttggatgtacactcttttaaacgttcaaaaccacactttcttatgtttccgttcttttgtgtaatgccagattttcagcctccatttcagggatcagattgttccatttgtcataggaatgccacatcacattttcttttcaagtgcaaggttacacattacagacacccaagtgggtgggttaacttcacatctttctttctgaagtgtcaatttgcactaggtgtaccaacagttttcttctattgaagtgtctgtaaagtacactttaagactattttgtgtgcccatcacaaccatgtacaaagctaattaccccttccaggcacttagcttaggcattgtagaatccataaataaaatccccaaatcttcaacttcatcaacaggactccccagggagtttctgagcacagtttaaccgtttttcttcagtactgcatggaccattcagccctgggaccacacaccaatgtctgtcatcatctgagttcagattgactgtgaccctccaaaatatcaatagtttctgccaggtccttcatttagtatagtttgagaatctgctttttcctctttctttagtaacaggtaatgatagcaggttctaataattcacagagattataccagcatttatttttataagatcattgaaaagtattaaatattttgaaacatgaacattacaaaaagcaaacacccattttctttgactctggcttgctaggattgaagggtcttattgtcaggtttgtgcagggaacacccaattaggagagtccatcatgcagatgttcacctgaaaatgcttttagtcttgaatgtagttacattcaactctctcacttctccttcaaacaagaatgttttgtttaaaaaggaaaaaaaaaggaatatcagataaagtcagtcttacagcaggcaggggatatgaggaggttgacatcatcgggtcatatcaggctttttaggtagagcatgctcctgtgatcgtaattctcacattgaatgatgataggtcggccaaactcaaactgcagcccttctcttacagatgaccaaccacatgatctctttcagttattttcaaagcagggcatctggagtccgatcagcattgccacagatggacccagagcctgagtgctgcctgccacaaacaaacacacgccaattcagatggtttaagtgggaaagtaccttctggctaagctgtggacacattgaaaaaaaagaaaaacacgcagattctgctccatcaatgtgttgtgaggctcctgaaaatgttttcctcccaggaatgtattcatttatcctttcaacaagctggtatcgatagtgctcctgctctgcactaaacaacagttggaagatacactggcctgcgggccctctctgtccaaggaacttagagtctagtgctggcattcttcatctggaacatttattcaaaacgctagtatttaaagcatggccccaaacacaagtcaaatccttgacagcttagaaataaaggctttgagacactcttttgcatatttattttcatatgccatacatttgctgtaccagagtctctgtaaaggcacatagctcctttcactcccctggctgctttccttgtctcccaggaaaagagacatcagatgaaaaacacttctgcaacccgctcttcagcacttgaggtcctgaacatggacacttttcctgcagtacatccacacccattctcaggtagttttgttgttattctcttgcgttttccatttaaacacactgaaagatatttaactgtggtgaggaaaaattccaacacaatgttgctaccaaaataaatgccaatgtcaaatgaattattttatatttcaagttgacctattttcagaaagtctgaggagagtaagaatgatttcttgaacacttacatttttttctagcaaatatgttgatctcaacacagcccttttttgttttcatgactgttttcagtggtgttaatatgtaattttatgtaacactatattgggcaatgtagagaaaggaagaaacaaaacagggagaaaaaacaaaagaccctagcatttaagaggaggcagagcaggcacatgtgatgagaatatattatcttccactttgtagtaggaacaccgttgcccctgaactgtgtggcacttcctcctaaggggaaaaatgacagttcgatgaggaccctgttagagtaagcactcagaggaaacctcatgcaatactgaaagaagtcaagtgtggaagaaaggagagaaagacattgctttatctagtatttttgtcacctagcaatataagcaaggcctagatgtttggccagtttaattatgataaatcatgcaattaatgatgccatcactttctcagaaaaactcagaaagcaccaagagcctgaagaaactcaaccacatgtgcatcatcagttcaaaggttcagcactctccttttatctttaatgagaatatcttttccattgtctctgtttttccttacttatatgctttagtttcattaagatagattttcaaaattagctttcaagaagacattgagaaaaccctaagtttaatgttagtagtgtcatatgtgtttatattatatgcttcagtcctctgagttgctttgctctcaaatccctttgtctgctgacttctgtaattagtttcatagctgcttcctagcaagcaccatctctttcctttccccggtatcctatccagaaggccacaaaatattctggacagtaggagatcaataaatatgcctagctctctgtgaatggatagacccactatcacagagcttaacaagaccaaaaccttcatgagatccaaacctccagaaacatgtcctggttttactttcaggtaccttctagtggctgttggtttagtttaagaaaaaactttattgccacattagttttcataggtctttgcatgattagatatcttggcctttaggtggaggatgcagaaacacagcaaagtcacatagccattactgattagaatccaggtagggctttaagcctcttttcattcactgagtcaacaaatcctactatgtgccaggcactattcttagtattggggttaatatagagatacacaaaataggcaaaaatccccatgattgtggagtttacataatagtgggaagagaatcttttttactacttggttcaaattttgagctttgttaaagaatgattcatctgctttttctgagacctggggaatccagtgattgaacgagccatcagccagccaacttaacactaaagatataggacaggcagacagcttgctgtcttccctgctgtaggctagcaatgaatagatgtatttgatgtgaggataagatgtaataatctgtgtagaaaattcagtcaaaaattatccctgtagtactcagtaaaaggtagttgtaatgatatatgtaataatctatgtagaattattaatagatgtaataatctacgtagaaaactcagtcaaaaaataccactgtagtactcaataaaaggtagttgtttcattggtgtggttgttgaatcttgcagaaagagaatgctattaagatgttaacacaaaactatagctcagagctgccctatataactggaaactccctttgttcctgtgtcttctgaaattccacaagctatgcttaggatggcagcatacatccgtttctgctaatctctctctgccctctgtccctcccttttggaagtggagtacacctcctgtgaccatagcttctgtgatcacagattctatatgctcacattttgccttttaattttgaggacttgccccctttcattcttttgcgcccctagaaagaaaatcctttcattcgttttgctgttaaggagggagctgaggtcatagatgggcaatttaaacttctatgttgattcctttttaaaaggtttgggagtgatgattttggtaataataaatctgaaaaggcaatattaaggcatgaaatagtcatttatggtagcaaatacaaagtattgacataaaacaaagatgtcatagcaatggaaacatcttattttccctaatgtatatataggagtaaacatggcttttatggacatttcaaaaatcagacaaaataacaacttagcaatttttgtttgcttttattcattttacctaaatgtctcttccttttaactttctttgagaaaggttttaataactcaaacacttagctcccattttggcacctctaactgcatcacatttgttatttcattgtttttgaaatgacagatgcttctttcacatcttggaggaatgaagaagaaaagagttcatgtcagatataatgattactattaaaattagtatttctcccccatttataaaaaatgccttttttctttgtgttgaattgtatgtttttgaaccctttaaaccagaattgaagatatgcattttatgaaaaattcttgttccattagagagtgtctccaatagaaataactgaaaataaataatgaattgttttcttgacatccagataaagaagaaacttttaaatattttattgaattgaattgaactggatgtagaatgcagaatttccagtaccagttagattaataatgcccaaacaagagtatcatcatttcagaggatcatttcacgttttcatccctgaaatagtacttcttgatataggagatcatagaacagtgatactgagagaaatatataggataagtgtgtaactcactgagattaagaacatttttgtcttagaaaagttatatggtatcgttatccacaagatcccaacagtattatttaagtacctgtgaaatttgtttcagttacacaaggaatcatgaggccattgctcaagtctgagatcctggctttttgcttgaagattaaggagatgtttttttttgaaatgttacccgtgtttcagcaccaatatggattgtaattaattgttccacattaaaaaattatgatgcctacctacaaaacctgggtatactttatctgggaataatgcaggcatgtgattttctatgtggcttttggaaagatgggcactatgagttataggtgtggaaggaggaaattgggcagctagatctcagacaactttatggcattctgatagctatgaaaaatgggccttaaggattttcaaaaggagaagctgagcataatatttagaaacccaaatgtgtccatgtgatttgggggataaaaccaagaaagagacacacatgccatcatcagatgatatgctcaggacatttctgtgcagtatttgtaggctcgttcacaaggagaaaagatagcggtcctgtgaaaaacaatgtgtgggtctctcttgcgacatactgggaattaattgcacagattaggtaaacttgccctatatttctaatagaaccatcactagagaaacacaggttattgaaaagagctctgacacccagtcaaaacgattatgtttcctgaaccatctctgcttgtagataagtctggttctagatcttgtccaaatcattgaatttaatgtcagttaggctaactaatttcaagctcctttgcagctctgtggttttctgggaatttgcattttttttttaaagtttgcatcatgctggaggttgatgacaccacctttcatgtgggtaaattatgccagactcttaatagaatgatgttggaaatgtaaggtggtgatttgcctgtatgggttatggaagtttaggccatttaaaaatctttggactggtctcaatggtcacacactcaaactgaaactaaccttgatgctgtcggattcttggcttattttctagcatgggagcagagcctttggcttctttctctgtgacattgattttggtcaaaaaaaccctccttatctgtagcagaaatatgcacaaactgggccagtcttgtgacaaggctgcccatcagctattgcattccatccagctctctcattcagattattgacatcctgatgtttgtattgttccaggaccatatccagggtaagctttgggaaaaaaattatagagttgtctttttcagtgaaatatgatgtctgttaccctttgttggtgaaagcacattggctgtacatgcattgattctggtggaggtgcaggtgttctctgaacattgcattttctctatctaacctttttattcttgccgtgtccacattggatagataaatagcaatgtatgtcaccaggtactgctaagatgaagatgatgatgatgatgatgatgatgatgatgatgatgatagcatttagtaggtactggtgtgagtcaagtactaaccatggaatgttacatccacagaactagtctgtatacatatgtgtcatcaatatgtcagaggaaattttgtaaagcagaattccaatttcccctcttatagtatcattttctgcctttgatctgtaggtgtgtatattaatttgcttattttttaatttgtattcaggaagaaaaaaagattttgaaatgtgagattgtgttagttcctctgaataacatgtcacaatgtagaacattcttgctcatagtagaagctcagtaaagacttgttatacaagtgaagaaataaaacactggcacaaggcctttcttcagatgtttttattgacaacagactttccttagttttaatggcattcatgattattatggtgctactcctttgcacagctttggcatcagttccttccacttttggcattctgctaaatgttgatcttggttatgtttgatccaggttactacacttaaaaaagaaaatgtgagatcctatatataaccttctacatgtttataaaatgtcaggctcttagattaaagcttaaacaaggatgttcattaaaacatttatattccctgaaatcttaaccagaaaatttattttcttaaatgtcctcctctgttcttccaataaaatggttctctggcaattttggcattttcatgatggctcaagaatctaacagaatgcctgcacatgaggttgagtttaattaaagggtaaagctcctggttgagtgtttcttatacactattgaacgattgcattttgggtgtgtaattaatgtgaaaatttctcattgatatttttgatcaccttgggaaaatttcagacttgctaaagatattagtatgtgcattctattcatggcgttgttgctcttatttttgaaatgattacatcccaatgacttttttttacttgctttaaacttaattttaaaggttcaaaatctttcttaaactttaacagaataattgttttgagaatgggttatatgcttggcttatatagtattgcaatatttatatatctatgtggcaatttgacaaatcaatcatcaccccaatatacaagtggttttcatttacagaaccatgcccagcttaaaaagaagaagcagtgcatataagcaaaacatttcaatttcaataagtaaatcttgactgtgttgtttcatcataaagtacccattgctaatttgggttaatattcgtccttctcttgtttttagcataaatattgtgaagaaagtgactaatacagtgacactcccaacttattgataaaaatttacctttaatttccctttcatcggtgaactaaattattgccgaaatttgaatcaaatctgacctttctttcccaattggtagcacagtgattaatatgtgtaatacacacacacacacagacacacacacatacacttaggacatatctattttgatagtgatgatgaaagacagcatatcatatgtggtgctttgcattttgcctttgttctccctacctttcttcctcatctccacaacctgaattgttactgtgttcaactctaaactaaagaaataagaaacagcgtgaatataaagtgatatagcaattattttacttgctttcttcatggtaaatagtttacagcattgttgattaatttcctgtagcttaatttgcaaactattgacaaccttctctaaatgctacccataaaattatgtttaaaatagtatttccactaaaaaaagatagtaacttttattttgtgcatttatatatagtctcttctttctccttccatccttcaaactgtaacagttgaaatttggccagaatatttattaaccaaatgttgaagaaaagatatttgttgaaaatagtttgggttatttacaaaaatgaaagaaattgaaacagatcaaaatgaaatggcagtggaagagtccggttagtctggtgagcagaaagctgaagtagggttgatttcctggcactgctttctcagcaaagagaacaattttaatcagttacaaaaatatttgtgatccatatgttcctctctgctcattcccatatgcccattttctcttttatcttggtagatgatgactttatgattcaggcatgcaagaataatacctcgctgactttagagctcggtgctatttcaaaacgtgtcctggtaattacgcatacacatatatccaggctgtccctgctttgagttagttatgtgaatatcagtttgttctttctctcttcctggaaagaattatatcttgcatcctcctactgaggctggaataatgcatctaagacttagttttggaaattacattgctgttcacctgctgagtgaactgtacaaatatgagggtcttaaagagaaatcaaaagagtttctgtgatccttgagaacttcattcaacttggaaaaagtacaacagaatccagaatgcttttcgtaaccatcactgacatttatgctaagacatattagataatgggcttcttagttaaatagtttctaatttttaagacacgatgatttctatttaatattgagtattatagtagctatggtgaaactgatcaaaattgaaaaactaaaattactattgattagcaatccacttttttcctaaatgcatgtctagctctcaaaagccatataatttccaaaaatggaagaaacatagtttaaagtctaatcatccatcttcataaaacatgaataaatccagaaactattgactgtactactgattgcattttcaacagttgctttccccttgcacaacaaatggctttgtaacccaatatgttattaatatagccacagtaaaatcctgtaaggaaccagctgtgctcatttaaacttgggagaagagggtagcaaggaggagggagagagggtttctaactctcaaactacgtaactgggatgcatttagtgttttcatagataggtatgtgttggaagaggtgtgcatgctgttggatttagccgttgtgcaccagaatagcgttatagggaaaaggaagagatgcagcctgatttgggcaaatattattaggagcccgtctctgtgtttgcattcaagctgtctttgccgctgctcctgtaggagttgtgagaaagagaaagtgcacattatagcgtggattgttttcaacaggcttgaagtttgcaaatctgctgaatccctctgtcagtgtttctttgctgtcaaacagaatgcccagctggcagtggcaatcccgatggggagggagggctatggatagattgtgttcaccctgcaacaagaatattaggaattcttcttcccaaactataagtagagagaaaagagctttctcagccatgccattataaaagttttcttcttcttttttttaacttttatagagaatgtttcattaaatcaaaacctttctgtacactttattcaggtagctttcataaagagagaaaccacataaacagcattaaaatgtataatgtaatctataattaagacaaaggctttggttagaaaaagaggcaagacttttgctcataggtgatcctgatcctcattgaggcaaacacacaagcttttttttttttttaatacaaagtgcgagatttcactaaaaaaggttaaaattgaagtgagtaatcttcggtgcataatgcaattgttaattttagctccttgcgtgggtgccgttctgacttgaacagccggctgtagccttcattagagaagaagcaggcagcttgagacaggtggagctggatcaagctgtgaacgtgatttgctggaagctggtcattagtgttagaaaccccgtcttatttatttcatccttcaccctaccatgattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaaggtaaaggtcttgttgtctggctgtcatctcatctgcattttagatttattattatataaatgtgcctgcttgcatccagcagttcactgaatgtaaccatgacaggatctgtatcagagactcatttggcttgtagtttggagaattagagctcaatttgttcactccattttaaatctggtcatgttctgttttttacttaaatactctaaaaaacaagttagggcaacagaagtcccctatccaatgcactgagaaacaagctgtttgccagtggaaaatggaactttttattttgttaaccacgcatactgagtgccactgaaatataagaaatccgtcagaatgcactggatgaaatatcctaaaacctcccaaaacctgaatgcattgcttactagtcactttacagactcaaactaccatccttttggaaaacctccttttgcattcccacaatcctttgctgaataagcctgtgtattttaaagatatcattagataccatctgttttgtcatggtagattttagcaaaatttctgtggtttgtatttttctcatacttcctattttcagttggaaataaagttactgaattagtaaatggtaattgaatactcccaaagaaacatattaaaactcttatttgtctagtaataattaccattgtaatgactgggaatgggacagttattgcttgggatttttttgaaaagaactaactttctaagctacagcgcctctctctgcttctccttctccttcttctttctttttactttcttcttctctctctccccctcttccttcctcctcctccctccttctctttcttctttttttttctttctatttttctcacagcttaaaaaagtgaggaggaagtaaatgctaaattattcatgagcctcatttgacagcacatcagaaggggaagtgtcaggggttttataaaggtagggagaaaaaaataataacagattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaataccttgcactgactttattttctgatatcttaaccttctagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcaggtgagtgagcatgaagagaccctgactctcatacaactgtgtgcagctcccttcttttattttcagaatactttagagatttattttttaaagagtttcactggttatatcattaggaaatgctagtctcctactttttcaatttttgtcactttttgtcctaacccaaccgtgctctaaaatgtgttttgtggggaaaaaagtcataggaaagtatttattttctgaatttgcacacagcatccccttaccaatttccagaacacctcaaggtgtacatagagggcttctcccaaggcagctttagactagctgagttttaaaaatgaatttgctattctgtggaaagatgaagactcaattcatggtaaactaagaaaaatcaaaggcaggtgttcctttgactttcatgggcatgctaaggctcaaatcttagtagcaaacaagctaaaccctagaattcccagccaaagagagagtacttgaaggaggaaaaaagactgggagtgattaaaggaaatgaaaaagtgctgtgaaacatatcatgatttacaagggaaagagattcggtagaaggaaagcaaactgcacttacaaatagcttgtaagtattgattttcttttaactaaactacagaagtgttaactctttatataccaacagttaacaaaggcagataactgcatgatggccaaaaaacttcaaagctggcttttccttgtcccctttccaatagttgttataaacagaaaagagctaaaagttagtcaaaagttttttaaagctagggaaggaggagtcctccctaatggttgtgatgttctgttgctattattattgacttctctactgtagccggtagtgacatttttctctctttctttctctctctctctcggttgttgatttactgttcgtttttgtttgttttattttattttgttttattttctttccaacatacagaggcggctggaggctcagaatcaagaaagaagaaaatccaaggtagggttcttaacattctaggtagacctgatatcatgggtataaattacatattttacatcagagttaaaggatttgccagcatttcagatgattgtgtccagatattgtggggcatctcggctgtactggtgctggctgtttttgatggggttatgtttatgcatgtcttactttatggcactgcatattttttagttagaggatttagtgttcaaatagctgcaaatgtatgtatttgatcctgtgttcacacttaagagatttgacagtactttacaaaacaaatgaccacttgttttgtgttcacacttagagatttgacagtattttacaaaacaaatgaccatttgttttgtttttattttaaataaaatttagagtagaaattttattctcactacttgatttctgccttgaagtaaacagatactactgtttagtacacactcttcatccttttaaccatcttctcagtcaaatctcctgcaaacttagttttagtaaaaattaattttatcactttttcctcctgatattttcatgaaatgacagcaattcattcttcctatgttcccaatgtgatgcacacaatttactaaaagtattttttttaatttatctattcacattcttctttacttctatccccatcaatacagaggtatgatgctttgagccaatgtagacagtactgattggcagacttgaagtttggttttaaaaatctcatttggggaagttatgtaaatgtggagatgatttggcagtctgagaatgcttcctgtttgttttctttattttcctttccttcccttttctttcccccctcctagtcaggagcaggaaaaggtaaactgactcgcagccttgctgtctgtgaggaatcttctgccagaccaggaggtgaaagtcttcaggatcaggtatatccccttgccattatcattaattgcatgaatgggatccacctttgtgtgcatgactcttaatttggtgttaaacagtgttttgggggagaaaaatataattgaagaaaataattcattttttggctttatcccctgcttatgcaacattctaaaatagtttaatggtttgtcacagagtattaaatttgtttttttccagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaactctatagcacttttgtgtgttctttcaacaccgtaatatatatgcatagaaaagatattttttttcctgagtatagtatttgtcaacacatggcatcagtttgtacatttttttatagtggatattctttagcctctgctcatgcatttataatatatgtccaagcctctatgattttagattcatacatacagaggctggttgtttcagtcagttttgaagaagcaatgagatgaccttcgtggcctgggagccctcagtttcccttgatgattaactgtcaaactgaatcttccccacctcagccacgtcttctggaccagaaatgtcccagtgatttctttagcaagtagaagcaaatcctatccctagaacctgcctgaacctttgcatattaagacatttctgtcccaaactgcaataaatgactctataatcaaattacactcaggttttacaaagtttatatatgtacatccccaggaaaaatgtgttgaagttggaaaactcagctaagatatttatgatgaaagtatgttttatttcatcatttatattgcgtgacattataagcatagtgaaacagggagttcacagtggagccccttccataaaagaaacttagcttcagagaacttttctttatgcttgttagattagccaggtttactgagaaccattaagaatcccaaatttgagagggtacaagcatcaatttagtcacatgtagtgtgagcattagtttaattttcagtgagagacattattagtcattgggattattttttcctacatcataaattttaatgtcactagtggaagaaagctttgccatcaaatgatctcttacataagaataagtgggcttaacgttggttaatttgtcatagttttaatcatagcataggttttacataaaactgaaaaatatgatttggctcattcttcttcaaaacagtgaacatactatcaatcaaattgctgatatatgtgagttaatacaaaataatctattttcagtgcaaaataaataagaataaaagtggatccagtcccaatgctgtaaatggccaatcttaaatcaaacatcatttcaagacaatattatattttggaaaggactaactgatgctaaaataaaataatattaaattttatatattatttatgaaaaatataattctacttcctaccttttctaaaaggcaatgcttattgtaactattcattataatgatttattagtagtatttataaacaattataataagtttatacctagaattcctgcaattctatagtctgctttttcatagtagtagaaatcattgttgacctgggtctaaaattgagtttttaattgtaaattcagtaataggggctttctttatgtctgttctatttgtaattatgattcctagtatatgtctgtctttgtgccaatttccccttataaggaattatagaatagaactacggaggactttttttttttaatacaatggctgtgatgagagcttactgataaagaaattttttctagatgtttaaaaataaacctgtagaaaaaaataagtattgtgatctacaggaattcaacttggttaaggttaatattcataaggcaaagttttagtactagatgttccttatgacctcccattgactcctgaagattaagtcattttaaagggcaattaatttcctgacaggtttaatttttaccatttagaaaaaaaaaatctgcacctggttttcatttttctatactttataacctctatgcaaaatgggagccagacagagatgattaaacctggccctaaattattatattttttccccaacaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaaggtgaatgtgaaaatatttccttaacttactcaatttgggcacacacatagtcacagaacacattctagatttcacatgcatattcacctcccaccaaaccctgcatatgattctatacgtgtacgtatctgtgtgtgtgtaaaaaatgtgaacttgattttctttctgtttatagtgtcattacttgtgttgctagacaggttatttttaggatcacatatttctttggattcacattttaatcttctgttttcagtgacaagcttgtacaaggaataaatataaatctgccctaaatttaggtttcttggaccgattaacttggattggtgaacagtaatgataccaagtttgatatcttaactctcatgtttatcttaaaagacagagagtggattagcaattctcagttcataagtgatatggtccccaaagtacagatgtatatgtcaacggaatacatgattcacattttatctggctcagaatttagtctctgaacccatctactatcaagtaatgtttatttaagaaatacccacttctacttcaataaatcactgtgcaaaaagtcatacatttacaaactcaaaacctacagtccaaactgtccaaatttttgccatacctatcatggtacaaaacaaaactaagttgaaatgaagagtaccatgagtaaacaggcttgcagtagacttaaacaaacaaacaaacaaactggacaactgggaaagaatagagcatctggtcaactgagaaatgacaaccgcctctaacagttatgtgttctataaccatacatctgcttataattgttgtttctgctgaggaatatctaaaatccaaggtgtatatgacagtaaagaagttcaggtttctaaaacagttttagaaattaagctttggacagcattaggatatttaaaagtcttgggaatatttagtgtcctcctgtattttgtaccgattaatagatagtctcataacagaacattcatttttttttttttgccttctttgttttaagagaaaaagggttccatgggatctcaaactcttgagagctctctctgtaggtgggagttctgtcatgtggggtttgtgcccttgttatttacaatgcagaatgaacacgtgatatttgactccacctctcccccacacccagactgtgcccacttcccctcctatgacatttggatctttccatattcaggatttattgggtgttttcaatcccggaatctaattttcattctgatgttatattgccagattgctagttttgaaacatgtatttttataccaacagcttcacctaaaatttatctgagcagggggaaacaggataggttggggaaaccttttctaccccacctttccaccatcattcctgacagctccgtcctgctatttgtttcagattgcagccaagaatacacggattctacaggcatagacttacacgagtttctgattaacacattaaagaataattccaggtaaattattaaatgagcctcttatttttagaaggatcaaatagaatattacaatcaaagttattaatccaacacttctaagaaagccattgtgaaatgcagataccttccctgacgtcttaaactgtctcctgtattttttttctactaatcgtttgcatgtttactttttatagagagtcttagtaactgggtagttacccaattaataaattatactttaacagttctgcttttcagatcacaaagagatactggctaaggtggaaaaatagcaaataaaaattattgttgtcaaataagccaattatgttttaatgcagctatgtattcatttacagtcaatacttggccttcgttttgttccagtttcctatttatttgaaatatactatttatttgatgggttttttgatcctagtactttgcatgccataattaacattaagactacaaaatttagatatttcaatatacttaacaaataagataaggaatactcttaaacaatgaaataaattgtaatgaatgaaatgaaataatatgtaaatggtcagcatattccaaagaagagttaggtataagtttgtagcagcatacatttaagtaatcttttccatacatttaattaattctttaggtttttggaagtggaacatacataaaaccttttaaatttaacatttattttgcagggacaggatgatacttttgaaaatggagcaggaaattattgatttcattgctgacaacaagtatgttaaacttcaatgctggttaatttgatcatgtatcctagtttggtattggagttaaattgtccattctggaaagacttagggatagacaaaacattgtttaatatgttccttgatttgttaaatggagacattattggagttaggactatacgctgatgagaattgttgcttggaccatgtgtgcttctgcttgttaaattcctgacaaaatggctataaacagtgggccactgattagcatagagtagctgtaacaagaagagacccttttcatttttattatagttttttaatgggctccagctggctgcagtcagttatgcctggaaataattgtgctgcttcagtataaaccgtgtaatgacacatctccatatagacatctgcaatcacgtattatgtcacatcatttgtcctgtgcctggccccgttgataaggtatcatggactaaaatacaatactgtccaacagacattacattctctttggcaagagaaatgtgcaactatgaaacaaagatgtttattgtggcttaatcaataaatctataataagtagaaaatttttctagaaattaggacattaagtgatgccagaaatgcaataggcttagtggtttagatgaagaagaaatagttttgtgtgtatacttgtaaaaaggtattatgggcaaaaaatgaaaatgctgattccactttttcttgaattatgttctagtaatcattataaaaagttccctcagatgtcatcgtatcagaggatgcttgtccatcgagtggcagcttattttggattggatcacaatgtggatcaaacaggaaaatctgttatcatcaacaagaccagcagcaccagaatgtaagccccatcactgtacttatttagcattttctttttctcctatggattcatttataagatcacagtataaaattcacagtacatgacatttaaaatgtgcagtgttatttatctcttgctcttatcagaagtagtgtggcatttatctgtagaagattatctgagaaccaagaaagtttataaaattcagacaataaagtggatttatttcctgctcttttacatagctcctgaaacataattttctttcttccatcagtactctatgaaattacatacaaagctgtgaaaaattttgtcaaaatataacttaaattaaaaacaatagatatttttaaatgaccatgacatacacagaataattgttattttctttcttctttcttctgcttttttagacatctatcttattgtagtttctggagtaataaaaagctccgaacctagaggcagaaatcctgcctctaaaacccaattctacttactagttgtgtgacttggagcaagtcatttaaaatctgccatctcagttttttcacctgtaaaatgagagttttaagctagatgaaacatctaagacttagctctaaaaagaggatgacaagttttttccccctaaaataattgtttgtttttctcttaataccggttcattgtttcactgagtcaccaaaagcataataacatgagtagtcatttgctttgaagcttggagctgtttttcttgaacctatatatctttggagtaccatacaagccaattttataacaaaaggcatgttaaactaaaaaaactgcccacataaagcatccatttttataattttcttttttcacaatgtgcttggtaaaccgtaaattgcatgctctttagaaatgttactgaagggagcttttgtgtcaagcagagtatcatggttaaaatactctatattttctgctcaccagaggttgggacaagtggggatggagatgaggcgctttctcaactcaagcatcagtctgtgctcagcagaggtcgggggaaagtcatagtgaagagagcacaaactgagagatctgggaccaagcatggctattattaatatctcagggacaatgagcactccacttctgtgggcttcaaattacttatatatctgcaggatagtttgaactgaatcgtgtttaagggcccttgaagtttcagaatcattcagtcctgtagttgcattctactgtgttagcaaaacacattttaaaaatttatcaggttcctattttatctggttgtttacacatgtgcctcatatttgaatagtagtaaaaattaaaggtaacttttagaatcctttatatcttccctctccatgcaatactctttgttgttgttgtgttgttgtttcttattcttcattttttaatggcttttagatatcatcatgcagggacatgctgattgcaaaatagaaaagcagttgactacttccttttaatttttttcttcttctttgtctataaggtcatagcaaacatggaaaactcccatagttcaagtatattaaatgtgatacagtttcaactggtggacagtagatttatttttaacttacaccaattttgcaatcacatagtcataaatactggtacatatgttttagacatgtttcctcggagaatggctttgagaaaattaagcattatatcaagactcctggtcatctttgagtgctggctctaaacctgatctgcccggtatggtagccaaatatggctatttacatttcaattcacatttattaaatttatataaaatttaaactttaaaattcagttcctctatcaggtgagccacatttcaagcagctattggatagagcagatatggaacactgatatgattttagaactttctattgatcagctctttttaaatccttgtgtttcctgcaagttcccaaataccactggagaacataatttgtcctttaaaacttttattttctggctagtaggtatcatattactagaatttttcacttctagaagagtgccagctttttttttaattaatggccatttaaaaatagatgccacatgtttatacctttaggaagagttgaaagtaagtgtgtgcagagaacaccctctcgaaggtacaactgctacaacaggaaggccagggctcagtctctggctaactccttactcttacacaccgccatttagacaccctttcgtgagtcaaagcaaatcatgcctaaataaaaaaggcaaatgactgtatgtcatggactttcaaggtatttactgaagtgttgagctcaataatgttcaattcatagctgtcatgttctactgttctattctaactacacttctgaccatcctctatttgagtggctgttgaggtatggtggtggttcatcctctatttgagtagttcttgaggtgggggtggataactgatgtattttagcacacgaaaaaagaggatgaattaaatctctgtatccaaataggaacaaatcacagttttcagaacctgaatcattgtcagcaattttagtgaaaagaagtgttgttttgtggaaaattatgtttgattttaaaagtctgttgccatgctctttggggttgaagttcaaaatggggcattatattcaaaacattctatttaagttctaagtgtcttggtttttttggttttgtgaaaaacttcagagttgtcttatcagggcaatcaacatgtgttggtcatgggaaccatattaacttcaaaatatttctggattgaaatgtcttcatttatttaaaggagggaatactgagatgagaatcccatgtgagttttgtgtttggggaataccttttcaatatctagagttttaatgctactccagtgcaaacacatgaaatgcatattttaatggcactatagtctgagagaaatgcagaaaaatgtggattgagggtatttttgtttactaagaggtagagggaaaaaaaacttccttttatattgttcttcttcagtgacacttcaatactactctgacatcattgtttaaataattgtaactatttcagctccttattggctagaatttatttcccagaatcctgattttctagatgataggcaggttaagtaactatagaatgtgacttgagaaggttgggtttttcatggagaagaaagaatttcacataaagttcaaaatattcagatcataacaatacattctgtgaggattacatatgtgtgtgtactgcactgacctctggtatttttaataatatacccagatataatctatctgctcttttatgatgaaaacaacttgtctcaggatatacttctgtttgttagatatcatcccttacttataataacattgcctacagctaattcatttcgccaagcactttacatcttgtaataatatacattttcatgaggtaaatgtatattattacatttaatacaaaaaaaccttaccatataaataattaaagcttcattttgcagaagaagaaaattaggcacaaactgagttttagtttggggcttacagggaagcaatggttagcatgactgggacctaaaccaatgtgtctaatatcaaaaagattttttttaataatcttattctcttaaagcaaaaatacccagaaattattgagcagagccttcaagaagagtccctggattggctaaaaattgcaatccttttaagtcctttgttgtctgataaaaaacagtgattgatggacaagatatttttgaagattaactcaatggtatcattaagtaacagagcctccctacaacttgataggtcttgctagatttgctgtgcttattactgccacaagatgtgattttttgaaggaaagcatatatatatgcattatatataaatatatatttagatattatacataatatatatatttatataaatgtatattatatataaagtttaaataaatatgaagtttaaataaatataaaaatgtaagctttactccatttcactctttttttctaagaatgaaaaagccatatttattaattatgttcgtaagagggggtgaacctcttcattttgttattacaaaactactgccacagcaatctgattgttcaactccatagacttatgccacatctacaagagcatcaagtgcggtgagaagcaatgagacaagatggaaagatagttgaagtaaagtcaactgtctagagattttacattaatacattccaggtttctgtaaattacctgataagagcagagatgttatgtttttgcagtcatataatatacacagacaaaactttccagatactgaaaacatatttccagcaactacaactcaccaacaacagacttcggtggcggtggtcacacaaaaaattacaagatgggattcatgtcctcaaacgttttacactatagttatagtgggggaataacttcagaatctcagtcctcttaaaacttgaaaaatgtagtgcaactctttgtagatccaaagtagacacgtaacaaatgtctggacaatagctccataactgaaggaacagtataccaaacatccagcagaatgtatgtaacagattcattggggactacctgcccatccatttcatggttcaaataggcatttaggaaggctttgagaaagggtaagacttaaacaaatgtagtaaggagggggatacatggcaagctggagtatgggctataaacgaacataagataaaaatctctacatttttttaacatttactaagagctgggcattttgttgagatggttgtgttaggttttcagagccacctaatgaaaaggattttttaaaattatttttctaactttactgaagagaatatgtaccaaagggaaattagtgaattgtctaaagtcatactgctgcacagtggcagcaggatgctaattcaggatatttgacctcaaatccaggagactttaaaataatgctctactggctggaggcaaatatggagagaatgatattgtcaatgacagtaggaggctacataagattgaatagaatcttgaaggcgggcagctcttagagctttagaacatgaggcttgatgtgtataacctgatactttagaaaggttagtctggtattgactaatgggatgtattcaaaaggaaatgaccaagagtagaaagacttaggtgagtgctgctgtcaccaaggcatggggctggaacatttatgaaaagtaggaaataatatttgtgttcatttgggaaacagttcaaggtggtactgtcacctgagcaaactgatgcctttagagaattagtaaaggaagtcatctttcctctgcagcactgcatttttgttggtgctcagagccaaccagagtaagaacagatttgtgtatgtgaccagtagcctccaactacactttttggtctacaaattgggtcttaatagctgggactcctgtaacaaatagagtcactgagctgagaagccctccacgttgtgttccttcatctttagttagttcctgtcttctatcccattgtaggttgccagaaatatgttttgctctgacacttttttatttttttatggaattttttgtcagctgtcagattaggtgatgctgctgaatgagacccttgccagggtgaaggtattagggtccatgttattttgatattataaatgatatttataatagatttactctacataatgttacatttttgatatttaggatttaggttaaaaatatgaatagtgatcttatcaaaatattttaaatgccacaaatatgtgtgtctttctatataagaaattttgcccttctctttctctcactttccgatcttcagtttctctctcttttactcattttctgtgtttgacacaaagcagtttattgttgtcctgttagatatatttttaaccttcctcttcttcatcccagagaaaggaagcacacttagagtgtaccattggagactagaaaccatcctcttgcacaagtgttttccaaaaagccaagatcagccacaggcaatgagaatcccatgtattatctgaatgtttttgcatatgtcagagcaactgtttaactcatcccagataattttcatgttaaaagattgtcatcttttgaacattttttgtcttgtcttttacatccacccactgtcattgcctcaaatcccctgctctgacagtgcagagcaaataaaggaaatagcaaatccactgaaagagagtggatacaggccctagaaactgtgaaacaaaaatagtggccgacaggcattggtttgaggctataccttaagtgcccaaggacatatccagtgatcctgagaagtgtgagcctgggtattttgcctggagtgatgaatggtgtgtagtgactatggcagtttgtttgttgtatgttccagaaaggatgagtaactgagttggctgtttggtaaatcataaaagccatgaaactcattctagaactaaacaaagcttccctatagatagagcaatggaaaccaattgattttattaagaacccctgaagtgatggatagttattactacatcagaaaggaggatcatgggactttccactttctcagtgggtagacccagacaacagtgtacagcagtatgccaaggtcacagaacatctactgtgcttagttttctgaagaggctaaagctgaaaatgggaatcctcggtgtttggcccttaagcatttcactccctgcaggtgattaagtacatttataacaaaacaaaataaagcaaaatatgcttttccttccgtgtttattatatttatcttcctttggctaggaatgtgcgtggctctgtgaataaactgagcatcatcctgatgtggatgcttccttaatcatcctctgaagaagaccaagcatcaatttatttaagtgcctcttaaaaatctatgagtggttggttggcatcctgtcatttctaaacatggtaaatttactctgcactttttacaggaatggcagtgaaaatcatctgactagttgccaaagatcagaaacctaagaatcacattgttctcaggaaaactatgaaactttatttactgagcaagacacttcgttttttaatctatactcaggctcaaaatgagacgtatttgttcacattggtcaaactccatgtcattttcttcaaatattatattttctccatattattattctcaaataccttagagaatataagattctgtagatgagataggtaaatactagaaatataccgtaagaaggaacataagtttgtcgtattcctttccctactcgaaattatttatgagcctttgagtgtgaatgtataattaactattttgaaaatgaaacatgcgtatatgttctataacatagtatccttaatataatattttatagagattttctgtggagtcatgatatgtttaataattttatctatttatttatctattttactcatgacatcctaggtagataaagctaagccattttaaaggagagaaaactgagatccatctcttgttcttatctagtcaattcacagaagaccaagatcaaaattcagtactactgtcactcagccatgactcttctcctaaagttagagaaagaggaattaacattaacaggcttaatactcttaaataatgatgaaagagaaacagaagtaaaccaagcactgttctttaactcgtacctattgattcacttatacaaattctaatttgcattttattgcctttaaaattcagcagagaaccaaattaaacaacatcggtactaagttagatggtaaaaatatgatgccaaaaaaaagtctccagaatcaccggacacactggattcacaattgccttggcatacttagaagtgacacaaaactgtttcatgttcttaaattatgtcagatgaaaatcatttctcaagtgttcggtactgcgctttgaacaaaagaagtatagcctatagcacatgttaattcttttcacagtttatttgaggagccatgacaattttgatcaagactgtgtgtgtgtgtatgtgtgtgaatacatagtatgtaactacaggagtgtctgtgtgtgtaaatacatactacgtatcatacagtttagaagttaaaagttcatcatacatatacctactagagatagtattgtcctaaatgtataatagttttggaagaagcaagattattgtggcttgatttcctcaatctgcatctttgcttgctataggcaggagaattatgcccagtacctgagggtttcccttgtttcttctaaattctcctgtagggctgacagtgattttagcacttgtactttgggaagttttagagaatacttgaaggtgagattctggttgtgtataatgaatatgataataataataacatgttttaatgttcagtacaactcttcaaacaataaattggaatctatcaagagcagtgcacatttatgtaacacattttatcccacaacctgacttctttcaatgtacagcccttcaggtaccacagtgttctcagaggagcatagcctttaacttcccaatcttcacttcccaccttctgggcttcaagccagaaaaatgaaaaaaatatatatagcttttatttacacgtaccaaaaatatttggcaattccctgtcaagtaaactacactagtaagtctgtaccttcactgggactgaaatactgtatttgcatatgggcttcaatggaatgcttttttatataacattacaatatataagcagaaagccttttgtctcaaaaaaacacaacaattatattcaacagtttccaaagaaaacatcactttcagaaaaatatgactgccatatttggaaatacacagatcaatccattattttagtattacaatacagattatatctatcctacttaaggttaactctaaagaaaattttggatcaataataatgttgtgcctttagattttttctactcaaaaaatatgaacggtataaccatagtttctaaaatttgttaagtgctttactagtgcccagcactgggcttagtagctttctcacatgattgtgcatgtacgtaatcctcccaagcaagttaagtattttattttctattttttacaagaaaccaaacaacagccctctccctcagagaggttaaatatattgcagaaagtcacacagtaagatgcagagctgaaaagacgtaattgtttttaggcttgcttctcagtgttatgtctgtatgctttaaactattttagctattgaaactattgctatttcaaatatagtatgctagtttatgcccattttatataaagaaattaggttatgtattaaaatgcaatggttgttttaagggagtggagctttgagtcattgtatgtattaatgctactatcatttaatgttcttatagcactgaaattgaaggatggagaatttaaagaaaaaaaaaaagtacaccaatactttatccctgattttagtcagtttattaccactgataagaaaagcctgagattagaaaacttgcaagaaattagtaccctggagctgaagaagaaatcactcatcatcagttcagtgttggaagtgaaaagaagtgaattcaacatgcaaagtattgtgcctttctgtcaaagtagcaccagagagaagtaaatgatcaaatatattgaaccaaatatcacatttgtagattaacactagattatttgtttataggtttacttagaaaataccactggagcttttgaaaattttattttactttttttattatactttcagttctagggtacatgtcgggcagtggggggctgggggaggaatagcattaggagaaatacctaatataaatgacgagttgatgggtacagcaagccaacatggcacacgtatacctatgtaacaagcctgcacgttgtgcacatgtaccctagagtttttgaaaattcaaggagcctaaaattgtcctaggctaatcctaaatcttaatcatgattgagattggtgataaatcgatcaatggaatcaatttggtggaatcctcaattttaggctaatccaaaacatttcaagttttacataggggccaaacaatctgtaaaatgatccccatgtaaaacttgaaatgttttgataatctcaagaacctaggcatatatttgatgttatcctcatattttagaatatatgtgtgcagtatttcctagataattcatataagatcatcctcatatcatttagaagaattgctgttctataaagtaatttttctactgtagacattattttcatttgtggaaattctaagtatataggtaaacttgaagaaataagtctgttttgttaagctaagtatatctatctgacctgtgtgactgttaggtgctgtcgccaacaccatgctcaatatagataatcaagctcacgcacctagtatataatataccaggtctgaattgcgggtgattactttccctttttaaaacttcgtattttccccttttctcttatccttgcaatctttctctataacatcattatttagtattctcctatagataagagaaaagagatcttcagagtggacagtatgatttagttattctcattatattatcattagtaaatggatgtttatatagatagataaatcaaaaaggacacagcaataaagggagtgattgacagggtaggagtggttgacatatactagatggccttagaagcagggatcataattaaatctgatattttttaaagtagcagcgcagtagaacaattaagaattgatttgacaaaacaaaatatctaaatacctattttaggtgattgtaataatacatgctatgaaagagcatgttctaaatattcaaaatatgtgaatatgttaaatatctattatccagtaattggatgcaaaccactactaagttgttgaattggttttctatctttttaagctaataatttgcattattttgttgttatacaataataattattttcataatcacaaatatataaaaggttaaaataaaattgtctgttatcccgccatcagacatacttactcctagcattattattcttacatattatagtttcaacataaatatgatcaaagcatatttatgtttgtattaattgcttttctatgttactcaatattattggatataattttatagagtcacatatcctacattacataccttaaattacttacctaatctactatagatttttcactattttgctgttgtgaatgatggaactctgcattcatttattattttctttggattcattattagaaatcgaactactttgtcaggacaaaatgatatttaaaaatttttaagtctccaaatccacgtagccaaattgtttgctacagcagaggtaccggtgtaagagatatcttccaaatgcatgttgtttttaaatgttgtgcttaatgttgttgttcatgaaaagtcttatgttaaaggagagtcaaagagttggtttgcattcctctgcttatatatacagtacactatagaaacagagaagaataaaatgaattttgcaagggtgtttcaaaatttggaacaagagtttgagagatgctaataaagaacattggctacttagcactgcacatattaagtttataaggtatagtctcatttaaaagaaaatgaggtggtataaaatgacaaactgataatgcaaattgtgagatacacttatttaaaaagaagaactaagactttcctattttcaataaaatacatccaaaatgtacatacttttaattgaaaatttttgaaatattaagggaacagtgtcattagatttctctaatttgtttgactattaaagtgcttttgataggtgtcttacaccatcaaaatactttatactgttgtgcatagaaacttttaattttatgagatacgtatacatattggtaaccacctttcagttactcagggtgaaattcaagacttttctctatgactctacatattcagtagaattaaattcttcatttatgtttggaaaataagggaaggattaaggttaactatttggaagaaaagtaataaatctggtcttaagaacctgactgtaaggtaaactattaaaatacttcaagataagaaagattaaaaatactaataataatgagtgctcatctatttcaagcttcaagggggaaaaaactaaaactgggactgaatgactagaacacaagagtttgattatcttcactcagccacactgtttgtcaattcatgagctatgcccagtgaaggaacaatgaagaattaattctgacttttcagaggtttgattggggttgccaagaaattgaccagaaatgccagtgctcttcactatacatgaacaatgagtttcacagtagttatgtgctacaaattgtggaaaaacatatttttaccttcagaagaagaaagtatttttcacctagaataagcattacatttattttccatgcttttttgatgataatatagagaaagatagaaataatgccatatgtactaaaatctaccagaaaaaaaaaagttaggcatgaatgatgcagggctgtaaaatatatagtgaagtctagtcatcattgatttaataaataccaccaccttttgcagttttgagaatgttttcatccaattacattcacatattaatacattaaaagttatccattatcattttaaataaaggtctacaatacattattttagttctattcattttattgcttagaaataatattgctacggtggtaaattaactttgaaagggagttgagttttcaaagctataatataatggtacattaccagtaataccagtaatttttagtttaatcacttgcaatacttcaggtatatgccttagtttgcatgagcttaaactgcaaaattgctctttagcactataatcataaacaattctctataaaatcaacctagaaaaattttattagattcacttgaatttttaagcaaaattcaaatagtttctccatgatcattcaatatttctggaaaaatacaaaaggattaataatttgaactattaaattccaatatttgagaaaaacctaaggtgtttgaaatgcagttattaaggatgcattttgcataatttgtattgggaaatatttttgctctaaacaatatttatattattaattagaataagccttatgattacattttagttatgttgtagatgcatttttttccaaatatatgaaaaacaaataaatgactactacaaagaaatggaaatgatatttttaaaataatgtttaaatagctcttttaaagatacaatgacacttgaaacttagaagttccaaaactaggaaggccacgattttcattcacacttccatgtcttcccaagatactctcagatttaaaacaaacaaaaacatttgtttttgtaacatgtttaattttggtcaatataaattgaaacataaatctgatttttaaagatctcactaatgctctaaatttgaatttatactcctactaaccaaattatcttctgatttataattataggatttaaaatttgatatattattgtgacttttttaatctgtccctgaattatagtgatttatgaatagccgcgctaaatgttcatttgcttatacattggttaatttatttattcagccaaatgcctctcaggtaccaggcatggttctaggcactaagacttaagtatttaaaaaagacaaggtctgtactgacatgaaacttaaattctaattctggttagtgctttaatgcttttcactttaatgcttttcaacctaaataagtcaatctataacaaattcactttatgctcatgaatcagaaagtccacattctgagataattttatttgtaaatgaacaattacagactattacaaacaaatacaaacaaaatttctgtaaatttagaagttagtaaatcatttcacttaactggagtttatcagattacagagcctggggatattagaagacaccaaaatagcattgatacaatcaacatctgtatttaagtcagcatcctaatttcacttgctatggaaaaaaaaatgtgtaacaacatataaatattggatgaaaatgttggaatgcttaaaaacaatctggagaatttctagtgtttacagggaactgcaagtctacactgtaatatctttacagtgtaataagaaattgaagtgtcttgtgactatgctacactgaaacatgtttaatttctctactgtaaatggccttttcattgtaaagtacaggtttacttctttagaatactaattttaatatgtcatattcgcactttcaggtttttggttacattttaagtttggtggaaaacatttacattgaaaagtaggataatttgatggaggaattttgttctttatcttgaggtttgagggccttcagcccactgtgtacaatatagaggaacaaaactgagtctctgaaaggatgtgaccaggctgtgtgatgcctgtggcttactgggcaaattcataaacgtgaaatcaaaagaagcatggagggatggtttccttctctttaaaagaggcaaaaattatttgcttctgcaccaaacttttattgtaaggatcgaataagatattgacaccatgttccaaaaattatactcagttaaaaaaactctaactgatattattccagttttttgctattgtctgctcatcaaaattattataatttatgtacacgtatttaaggaaagaaaaaaatgcttctcatcaagatttgaattatacacttaaactacttctttattttcaaagtgctatttgcttattttggagctcggagcaaatgataagtttctcttaattactggtcactcatattacacaacagacactgtgagtggcttcctaatgactcaaagcataatgaacgctgtagggacagaaaaccttctaggcttcagaagtaatatatcagatatgacagagaccctttaatgagagtcataaattttaactgtctaaaccagaaacaaacgttttagcacttcctctgtggatgaacccaagtccagatcattcattgagttctgtggtctgcaatgacaactgtgagaaattaacaaggaagtggagccctttcctttaataataccaaatgattaaaaagacctaaaaaaaatcaattgactaatcaatagtgtgtaactgcttgaagcattttccccatgctaatcaaccattaagttgtttaaactaaatacctccattttctccaattactgaaccgatttacaagacatggtcaagggtgtcagagtctactggagccagattccagagctttcgttattggaggagacagaaaataatttttaagtgatcctctctcactacacagtctaaagactcttaaaagggaagatgtgatagaagatattctgccagttccagacattggtgaattaatgtgttactctcaagttctaaacatgtatatttgtttgagaatatgggtaggaagttatttgaatttaggagtaatagaggtcaaaataactaaagaaaacatctatacaatatatacaggcaggcctttaaatttgtttttcaatttcagccatgatgagcagcatgtagcaaacaagaccccaaattcaaaacaacaaaaagtattctaacatgtgaagtgacatattattacctacctgtatattgccagcaactctagtatgaaaaccacttgtaaacttttaagttaaatgacactgtgggggaagaacaacactaaaaaataactttaaacaagggggaaaaacttttttattgatatgttttactttgctggcagaccagagcaaaggttttgtgaacatttaaaagatgaaaaaggtgaagaatcccagaagcggtttatcttgaagcgagataactctagtattgataaagaagacaatcaggttggttctcaagtttgagagtggctgacattgttgtttttgaaggtgggctgactgatgttcatgtcgtccctctgttgtccctgccttccctccaatcctcccctgcctctgataccactgtcctatctccaacctccttctcctccttccctccccctttggcattcaatgggtagcaaaaaaaaatatgtcctggttgctttagcaatggctctgtgttgggctgcatgggtggtgcttggcgcagtttccgctgcatgtctgggagggtcgggatgccacaggctccgagctgtggagaaaagctttgtcagtcgcatatccagatgtctgtgtaactatggcagtcgttccactccctacagctttgtccttcagttgtgcacaaattgagctggattatcaatacggaccgatgatcaaccggtgtagctgtaaagaacaaaccttgttatggtgaggacaggtggattttgcaactatcctaaaataagtcttcagagaaaagaattgagttcatgttttagtcttttatcccctctccttcccatgttttatggtccatgtaaattgtctgcttgttttgcatgaagtgtagcagaactttatccttgtgtattttgcttgtgacaaaacattatgttgttctagagtagccttatttgtggtacccggacaggagcaaagagaccttactaaatctcttctttagattggcggggggctatgggatccagggtgattagaagaaagctaagtaaatggcaaaaaaaaaaaattccataaatttttaaatgatgataacaatagaaagtcatataaatgccattacaattatactttgtgtctctgacaatcaaaatagactttttttgaaaatgactttgctttagaattcttaaaggtaagacaatatgcatctcaagttatcattttaatcactctcggtgagtcattcagccagtatgtgcatctctgacgcactttttaaaaacttgttcatcatttgtatctcgtttcctcccactgccaccaagctacaccatggctcctgttgactatgaaacatgtgcctgtgtcatgtttagtgggtgtctgttgaatggatggatgaatgtggttagtgcagagcagtttgtgaggaatggaaagaatagatggaaggagacttaagatgcaggaagtagtcagaaaataggataaagagcagtcctcatgctgggttctttgaagcattactttagagttcttggtattgactcttgtcaacaaacaggtttttaaaatttagcctgtaaacctgaggtcattcattctatgctaaatgcaattcatgggatcagtcactgaatgaattacacaaattagaagatgaagaaataatgtccacatcttcctttctgttaattactttctttgctcacttgctttttctccagtccccaagctttcaaaatgatttcttccctcagctaccttgaactagccacttcctcttttttcaccggcattctgcctccttctgaggagtcagaaccacacaggtaagcaagacagacagagtccatcagtgatgagccatcacgtatgtgaattggctgaatacctgaggcacagtgaggtgcactcgttttggaaacacctgtgctacttgcatccagtgaggaaccaaccagcagcagtaaacacctctcaccattgcatgtcatgcacacacatggtacatgcacccaacacagcctcctcaggaaacagagagaatgagatttttcaggctccatttgtttaagtgaacatttattattcttagctgacagttgcttaaccacagatttctaacaacgcaacttggataaccctcctgatttcttttttctgttcagcaaaacagaatgcatccatttagagatgacagacgaagtaaatcaattgaagagagagaagaggaatatcagagagtgagggagagaatatttgcacacgatgtgagtagttgttttaattgcctctttagtgcgctccttccaacagcagtaaggcttcctcattccccagacagcgaggtggcagggaataaaaaggctggagccagagaacaaatcaaactgaagaaaactagaggtgattttggaagaggatctggttcagggaagtgatagaaacctagccaagggtttgggtgtgttcttaggatatgactggtgggggcatgtagagaggtatgattttggtcagtgatacagaccttaaatacagaaagtgtttgtcagatttgaagaaatgccttcacctccacattagccagcagattacctacctagtgttgttttctttttaataacaacattgtacagggtaaagaattacaaagaagagagaatctgtttatctcacacacacatccatatacaacgagtattttctgggttgttagcaaatatggacatttcattatactaaatttagattatttttctcctcaatttcaaatcaaatctgtgaacagtttgtcaagggaataatcataaaacaaatccgaacaacaaaaaaaatggttggaattttttatctttacccactatggtcaagataaaatgcaattaattaaacattaaaaggtaaaaaaaagtagaggctggatttaaatgcaaggaaaagggcaagcaactgccatagcgttttcattccatgcaatcatttagcagcctcctcaaatgatgtgggttcttccccctgcgtcagtagaagtgtgagctcctttgtaagactccgtggccaacatggcaagctttgctgagtctagtggaatatctgatctcctgctgtgatctgcttctggagacaacacaaagccagcccagagaagtaggcttcagtgcttagcttggaggaagactgctgtcctgaaaagtttcaggccaaagccagtttctctgatcttccagctggtctggttccattaatatgaaagtgcaggggagattcaacctcctccagcactgcacttctttcacgtttatatcccgccccctacaacccccgccacctttcttgaacacactgaaatagaattttgaagattggatgatccagctaagagctctgaaattagaagagtgtgagagagagggagatggaagttaccattgttggaggtctggatgcaattttaggagactctgcatatgtgtaggctacttagaattttattatggtcagaattttagataatgcaaaatacagcctgacatatggtgggcctttaattgtgtttggtggatacaagaatgaagtgatgagatgatcttttccagtcataataaggatgcctacagtggcctggaaagtagcattttcctgtctgaagaccttcatagagcttcatagagataatttttttgaaagttaattcattttttgttcttattctctctctcttgctctctctctctctcaaacacacacacacacacacacacacacacacacacacacacacacattttctctcacactctggtcctggcaggtcaagtaatttatgaatgagttatgttgaaaagaaaatacaaatcacacataaaatgcacatgcaatattatgctgtttttaaagttgtgtcacattgttagacacttgacagctaggtgacaaagtctgtcactaatgcctgtctgtaatgaagatgacacctgtcctgcttatttcatttgccaattctcatggacaaagagaggtcactgggagacagggtctgcatgactttctctatacattgcatttccttacaaccttgttaacgagattaacagctggggatctgggttaaacattttaggcaagtgttgctatttgaagcatctatgcccacatgctgtatcaacagtttttaaaaaataaaagcacatttaaatgtgagaaatcttaaatgtcaagctattgccatagctttttaaatccatgaaatcatttggcagccttctttaaaatgctgtggcttcttctctctgtaggaatagaggtgtgagcccctttggtagcctccctagtggccagctcttccggctttactaatttgagtggaggaccagcctgtttctagcatgctttttaacttgatatcctagggcagcgttttaaattggcatcaggtacccagactatactcacagaagggcttgaaggattaactgaagtcccagacatcatttgcaaatcatgttcatgaacacgtgtgcattttttaaagaaatggtccctattgtatatcatattcttacaagtttccataaccgttaaaaggctaagaccctttctcttagagggcaagaaacacctagtgtctttctctatctgtatagctctgctagagatatgcaatcataccactggtattttctatgtgttagctatttgttgccttataacaaaaaattccaaaatttggcagctgaaaacaaacacttatcatctcacaatttctgtgggtcaggagtctgggagtagcttaactgggtgattctagctcagagtcttacatgaggttgcagttaagctgtcaactggggctgcagtcatctgaaggcttgatcaagtggttatctgctttcaaactctcttacatgattattggaaggcctcaattcttcactggctataggctggagatctcagttccttacaatgtaggcttctataggctgtttggtgtcttcatgacatggcaactaacttcccctgaagaaagtgatttaagggagaaagagagagaaagcccaagatggaagaagccacagtcttttataacctaatcttggatatgatatatcttcccagctatattgtcttggacactcagatcaacattggaacaatgtggaaagtaccacacaaggttgtgaatatcaaaaggcagggatcattgggggtgaccctgtataaagaggctattactgtatcctctattgacacaaacataaaggcagcacactttaggggaccctcatctagtacttccagatccccaaatgatcattactagtgcccaaatggctgaggcacaagatcattctttcataagatgataattacagtatattaaatcaattagagaacaaatgcaaagaatccagcataaggaaactgtgttacagaactctaatctttttcatagctggtctttagtttagtttcttcataatttgaaaactgagctaacaaagcggctttccttggcaattattatttaagcagtggagtgatttaaataggttcaaatattgcttaagtgtatttttttgctacttgaagtaaaagtagaaagttcagaaatacttcctggtatttacaatttagcaaaagtcaaatttattttaaaatcagaaacattcttgaatattttccaaatatatcttggtgtctaaggtgtctgtgtgtgtgtgtgtgtgtgtgtgtgtgtgtgtgtgtgtgtgtgtgtgaaagagagagagtgtgtgtgtgtatgtgtttgtgtgtgcttttgtatacaggcacataaaatatgtgatttgctttggggattttccagaaaaaaattcaaatccactttgagaattttgagattttgagataagacaaatttcttcattatttgagaactaaatagttgtaagtcaaaacaacaatttagaatttagtacctaaataataaatgtattttttgtagtcaatatatttgaaatgtaattcttttttcctttggcaaaactttatatttaggcttattttatggttaattctatgcaatgtaactgactttgggaaggttaaattgataaagcaatatacttgagaaggtatgttttgcctggaggctaatttctgaaggatatttgtgtataaatagagattcagtgaagagttcatctgtggtcctcctaacatgtgctgggactcctcttcagtggggatgggtaataagggcatgtggtgccaccagagctgagggtgggatgtgggagagaactctataacccattaagcaaaatcgtttttcttcttttgaaaagaagcaagccttttatatccgagaatgcatataagtgacagctttgaatgttgcacttaattactgtgacaattttatctttctctgctattaaaattattaatactactttttttaaaaaaaagtttattttcatcagctagtgaatcacagcccataactgtatctatcttatttatgaaaatgtagttgaggggataatgagataattttttaggaactttccaaagaaaacagaaaaatacttgagatattattgggtaaggtattttttttttatttttttgagacaaagtccctgtcacctaggttggagtacagtggcatgatctctgctcactgcatcctctagctcctgggctcaagtgattctcccacctactctaccaatagctggaaccacaggtgtgcaccaccatgccccgctaatttttgtattttttgtaaagacagggtttcaccatgttgcccacgctggtcttgaacccctgagctcaggcgatctgcctgccttggcctcccaaagtgctgggattacaagtgtgagccaccactttggcatgggcaaggtatctttgacttgcttgtgtcttactttttaatacagagtttggggttcttaactctcccccaaatgctattagattgagtctaaagaggtcactatgtccttaattaattccttcagacaaatagagtctcaataattccaatatccagacaaaacattataaacacaatcaaccactttccaactatgagagctgagaagtagcaaagtatgaactcataatgtatatctaagctaacctcgctttcttttacataccttacttgactccagccaatagtaaaaccaaattaaaggaaataaaagaagttaggacatttagtgtactgtaaagagcccttcataggcatatcaatggcacatcatttatgcttgtttccctttcatatataaatgtcaagttttttaaaaaagctattctctgaaaagctttatcttttaattgtctctctttgctttttcttaaatgaggtttttgcatacttgaaattcaggatgcatgttaagtgcagcaaggttaaagcataaacgattctagagacaccttcactgaaatgctcataaaactgagagaaacaccatgtctaaatctagcccattggcttagtggaaggaaattatttctctaacaaaatgaacatagaaaccaatattctgcctgcctctcagaagtggttacattagcaggatcttttaagtcaataattggttattaaaaggttattattacttctttagttttattttatcttaaaattgacctgttaagtctctatttattcctgtaacaagtcatttattcatcatttggaaaatctacgtatatagcaggatgtgtatttatttatgtttagaaacttaagtactttggaaatggttttgtgttactttctaaatacagtcaccctattataggaccacagcaccatatcttgtctagacttctcttttgtatttgtttaaatttaatttgatccacctttcctcagcatgtaatggtaatggaattttgtcctccctacattgtgcataaacacaagatagaagagaaatgaatgctcggtgaatagaagctaagaagaaagtcattgattttctatgtgaaaaactggcatatattagatggagcttgattttttttttttaattagcgtattttcatcctcacttgtcttctggccttcccctcttacttaagatcaataattgatggcatttcttctattttgagagtctttcagtcaatctctttatttcatgagagtttatcatcaccaggtaataatttcaggattgtggctttatggctctcccattcttaacgtggatcgcatggagtctgcacgctctgctttgatttgaaccctttcccttggcttctgttgtttggtggctgcagctctgcagctccagaagaaaccactagctcggaatccgacggccacacgtttctccagctgtttcattcacatttctcttcttctgacctccatgccgaacagactaaatctaaaacctggagacgtcctgaaggaaaaataccctatgctgcatgagaattgtttacttttctaatcctaaccaacctttttccttttttatttctatcttttgtacctatttttcttaattcttttcccctatgaggggaaagttagttttaaaatcaggcaagtatttgggatccctcagcatatccagaacttctgatccaatgccttttttttatttttcagtcagtttgctcccaggaaagcctttttgtggaaaacaggtaaaataaaatttacttttccatgtctttagaggaacaacgtctgtcatgtgtgtcttgtgtattcataaatatatatcccatatatgtgtgtgcttgaatatatgtattagcagatacatatatctatgcgtacacacatatatgttatttaacacatctacaaatgatctaatttggaaaaaaaattttctttcagttaattccaaacagaattgtaaaactttttcttatttaaagtctcaatttctggtccttgcaaaggtatacttcctattaccttcaccaggcattaagaataataaatatggagacatcacaggaacttgcagtttcattggcttatttagtagtctgctagaggcatgcatatatttggtattattggccacttcctgtgccccataacaatatatagctatacaagtaacaattggaataatattttcagtttttttattctaaacaatctatttttcttcataaaagacttgaccttgaaaatcttatctaaactggcctagatttagcagtgtacctggcataggagttagtagggggaggtagttgttgtaaaataaatgggttataaaatttaaagaaaatcttggtgataagagcaaaaatttttcaaacttaatatatacccttcaaaaatcattctaaattgacatatatattaaaatgccccattgatttaattgcggatactcagggcaaattaaggaatccaaattaactgcactaatcacatttaagaggcatcaaaatgagcaacttgatttgaaaatgtggtatctataaataaagtggtggttaattttatttcagggttttgcttaatgtgtattcctataccattgattaaaatgaagactgtttgattaaatgccagtactcagagaaatttaaactggacattaaagatgattggcttaaaaaattccatcattcatatttgcagttggaaatcttcaagtaacgtgactaaaccccttaatagaataacctcttcagaagaagagataaaattgagaaacacataaaagggattcacagaaaacttcaaagtccatatatatttagacaaatattccctatttacagtaaaatcagtaatccataagcattgacatcttgcaggtgatttctaaaggattccaaaaatactctatctttgccagaaagattaagtgagcattcacaattcagattcatgggaaaccttattctctcgtcttctagccaatgattttccctatcttcctccctaatcttatccatttacacttgagtgtcccttatattatgttggattatatcccacattacaataattggtcacatatatatgtattgccttctctttaggttaacaggtcttgatggtcctggaaaccaaaaatctaagtgacttaccaccaaaaataaatacatttcttggatatgtgcctctggaatgccaatatttcattatgccaaaatatgaagaatagttttaatatattactctaaaaaatcactactaatgtatttaattaaatctctattatacctatatcaatctcttttctcctcttctattccctctgcttcctctttccttcttttctccttacctagcatcggtgtcttaatcctagggtagagatcttaatcctatcctatgggcattaatttattatggcaaaattcaacatcatataaataaaactttgtatgggattgatttgtgctgtagtagagtacacatccatgtaaacacaaggcatttagtacccttaggttttatatcataaaaatcatgtttttcatttccagtaggctcttggaagacagtaacatatgcaatgagacctataagaaaagacagctctttcggttggtatggtttactttcttaaactgtgtttttttcaaattatgtggtagaatcaatgttaaatattagtgtactcgtgtaaaatatatctgttcatttaaaaaagtctggttatctctttgtaaagcttgttaaatagctagcgtggaagtcatattgggtagtatgagatatgagactggaaatctatcacttcgtctacaattcgttagggttcttctggttttctgctttttgggggctaactttggtagcacactgttttgattttcccaaattaactttagtaaattacactgagttaaattttcactgacagattgcaattgtacatacattctcaacactggaaaataaatcaatgatagccctacttgggcaactaatttttaattttatctgttatattatttcaaacagtgtgttttcaagggtgaattttatttctgaagaaagatatgaggttcctttcaattaaaatgaaatacttaaattaaaatctgtgtaggataaggggataggatgataatttttttaaagttctatactagactagaagctctatgaaagcagagcgaccatacccattttctcactgctctattcaatgtatatctgacatccattgtagagaaaagtgtacacagtactataagtatactcagtatccaatacatatatttaatgtgttaatgtgtttatgagtgttaggatttacctccgttgcaggaattactacaagaacaacaacaaaactcttatccacttaaaagaaagaaaatactaagaaaatcagatgaattgaatgttgagaaagtacattttctgcaataattctggactttagaactcattatgagtaaaattaatttgttatcttacactttgattgaaacaaaaaacagaagcttctttttggacttctttcacttttctagattgaactattaagtttattatgaagtcttccttatgtatcattagacaattaattttcttttccacacttgaagatttaagaaaataactttgcacttcttttgaaaactcagagaaaagctaaaatttaccattagtcctgcgctcacacactgtgacctagtttgtttagggtgatatagataaaacatgggttcttgtcccctaaaggccagttagttttacataatcccaaatctgtccccaagccagagctaccatatactcaggttagccatctcaaatatggatttcatcacccacccaaataaccaagcacagaaactcagaagggtaacttagcacaaagccattcacacaattgtaaaagcaattcaagatgtagatcatccctagcccgtgcaaaaaagatgcatttagacataaaggaaaataaatattttcagttatgttaatcagcacagaagcagagcttaaaatatatgcctttgtaactaccttggaatgaaattctagttacttacaagagggcccagctccaatgacagatatctcattactatcatcttcctggattccagtaggtgattccagtaggagagtaacctgtgcaaaaaaaaaaaaaaatgcatatagacataaaggaaaataaatattttcaattatgttaatcagcacagaaacagagcttaaaatatatgctttataactaccttggaatgaaattctagttacttacaagagggcaagctccaatgaccagatatcccattgctatcatcttcctggattccagtaggggaggaacaagactgggcttaggagagaagggaagacacctgtgcatgtggttttctacaatgcctatgatcccacacccaaacagatttggaattcaatactggaccgcacttcaacactgttaagatgatagtgcaatataaaatagaggagtacaaaatatattttaatgtataaatacctaggaatcataaattagagttacacattatttttgaatctcattaatgctaactccctaaagcggcaacttaaattttcttttttaaatgtacagattatggcttaggacagtgatctgagctagtgaggtagaggtagagaagttaaagaaatcttaggttgccttattgagcaggtgatgtgacataagtctaaaggaacttcttacagctctaaaactagctctaccagggagaagggtgtagactacaacacactaaattgcacccagaaatagtggtggccaccttctttacctaaaaggcacagtcacactggcttttacagaaagtctggattcctgccatggaggtgcagagttcatggctaaagagattattgaagcagaattagtaatgggaacaagggatcacccccatatggagagcatccatctcatgcatcctgtactctgaggctaagcaccactcccaaatcatcaagccaatgtttttctataataaatatttcaaattagctgcaaatgagattattgtcatatttctggtgcattcacagttgctaaacaatgattttgctagactttgtaaaacatagtttaacatactcatgattatatgggagaagaatgaagttgaatttggagatttaaagagaagacaatcagaaatggaatagcaagcccttgaaaaggctatttatttctccgctctatctcccaaggctttcttgaatgtcaaaggagtttaagaggtaaagccacctggtcattggtgaaggtctggcattcatacctacaacttggttttcatcaagtggttcttatttctaaaaccagccatccgtgtggtactgagaacagagagaatgtaaaatattaatagaggatggagggcactgagtattttcatctaatctttcactcgaaagcgctttttgttttgtgaatattctgtaccccttcctccctttgctttacaaagttcctgtcacaaatcagttatttcatttttatttcttggatccatttatcttcttatgtttggctgaaataaaagaaaaagtttagtgagtaaagttaaagcaacacttaaaattttctttgtactgtctgtacaattttgtcggtgagtatttcaatcacatagtgcacttcaaacatctcaacagtacattattgtctttaaaatatttttcaatgaagctaccaatcacatctgtgagatttgaatcaaggcttaaatatgtctcattgttaatatgagttaggtgttatatttactgaccaagatttatattccctttacttatttataatccattaaaccttaaggtattttacggatgcattatttttatcttcagaaaaagctttgaatttattaacaaagttatgctttagacagattggaaaccaatgaaaatgcaaatttcgtcaaatttctctataaaacacatgcaattttgcatatttcttagagatactctacagtcttcaaacttcacttctggctattggatctcttccaatacatttactcttttttctatttgaagtttgaacaaatgtgttctttcacctgaggagctttttttgttatttccattgttccccttggaaagttttgtgtcagtgtatagtgtttacactgttgttattttcaaaagtttttctacgtgaaaataattaaagggttctttcctctgaccatgaaggttaaactcagtgggcaaaattcttaccataggttaatagagtaatttctgtgatttctatcctatctgtcaaagccttggtgatttcagatgtgtatctcataaagctggaacatgaattaacagcttctctggatctatgtgcatttttccattgacaattattttgtgctaaagagagagaaaaagtcttctttggtgggagttacttttagaatcatttaagatcacaattacttctgaacattaattaattattgatttgagtcaggagaagttatccccctattctatttgcaagagaaattaacaattacattttatgacatgtctttctagttgtttctccttcaccgacagagggatcatgtaacatttctaggtttggtttttctgtttgtaacctatgtgttatatgtgatgtgtcatctgtctatacatcatcaaagtatttgtaacactgggaggcaactggtttaatgaaaagggttggcaggaagggtcttgtgtggatcaccttccaagaaaagccttgctctgtgcctaccaacaccatgcatgtaaggtaatcctgtccctgtgcatctttctggtggtcgtactccaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggtagttagtactgaatgtgtttatgtcctgtggtattttttggattctacccaagccatatggtcaccattccctctgactttcagttgactgataatgatgatattaatcacagggatagctggaaatcagaaggtacaatttaaataggttactgactctttccagttatgtgcctaggtcaagttactaacctctccaagtttcagttttcttatctataaaatgtaggttatataatgttattcaaacccatctcagtagacttagtgtttatgtatttaatttaagcacttaagtttacttatttaagtttactcagtaaactgaagtttaaattgcattatttatataaaaatgattaccatggcacctgcattacagtaactacctagcaaaagtttgctgttccttttaaatttagtaatatgaattattccttaaaaacacgccgtaggataattataatattaatagctttcgttcttgcattggaatgctgttagtacgatcctggacctggtttttaaccattctgtgcctctgttttcttcatctgataaatagaaataataatagtacctatattgtagaaatattatgaagactgaaagagtcagtatacacaaagcaacttgaataatgtctgtcaagttataaacccccaataaactctagttattattcatttttattactgccatttaatgtttgcacccctgctttgcagataagacaggtgagtgtcagagaggtttagagtttccaagttaccaggtgcttgtatgtttttttccaagtgaagcaaataacgatattctgaggtaggtagttcaagtttgcatgaacagtctttggaaggtgagtgataatgagagatctaggagagccattaacttgaaacaactttaaactgatggaagcatacaccacgatgctcacatgagtctgcaaaatgccctcatggtcggccatttctagctcttctgtctcccaaagattattcactattgtttttgattattttcaaatgttcacaattaaaatacctcctaaaatctcaggaaggtgacaaatgaccattcagtagcactccatgaactgaagtttgtgattttagtatgtaattgtttttgctttgttttggttctgccttagaaaatcaaattccctgacactctcttggtttgggtggggaggtggttgggagttgtgattctgttgtatgctctgggtgtcagattgtatgggtggagcattcaggctcctgaagtgacaggtgagtgggaggccaaggcaggagtgggatgaagaatggagaaccccagttagagtttagacatgggctgccctggactgtggatattttcccaatcaccctttacactgatgttagggccaaggggttccccacctccatgcaaaatctgggttcatttgctaatggtttaacataattaggttgttgacaaattccttctaaaaattatctcatgttttcctatattaggagaaaattaatagcatttagttacagtcactacataatacacacaccctgattcttggaaagattcagatgggttcacactgcctttctgcaatttttattcactaattggtgagttcttgatttcttactctaattaattgctctcatattccactattgtagcaactgaagtaaagaaaatccactgtagtacacttgagctcttgtaaactaagataggtttaatagttttaaatctccttaaaatgtgaaaaccaagtactttaaatggtgcacttaaaaattccagcacaccaaaagagctcttaagatttttaaattaatagtcattcttcatgcaccaacccccaatcacttccaaagcaaagctctttggaaacatttaaaacacttcaaaaatgttaaaatgccatgttctttgaagaatgattagagattgtaagtgcttcagaattttttttcttttaatctaagtgtctccatttgaaagcttgtcaaagtgcaggcatgggaagggaataaaaacttaaagaagatcaaggtaggatgtcaaaacaaacttacagtttcccaagatggatttatgaagcaaagctgtcagtctggctgtcatggagcttcagaacagcacaagttttcagttttttacctaattgttcacagtggaattgcaaacttttttatgacctttcagaaaccaagtctggagttgtgacatttaagttactcttctcctcctctaattacatagattctagctttaaatagataataatgagactttttccacattggaaacacattttcctacgttttggaaggaagcatattactgaagtatgaatgtacaagcacattctcttgaggcctgggctgcctaccagatgcccaacacacatttctggaggcagatgatgcgattgtatcctccttaccgaaagcacttgaatgacacctgtgcggcaacctcagctgtttcttgttaatagcaatgtggttgagaaataagagtatgacatctgtttcttaccacattggcctagctatactgtcactattgttcccccatcttgatcttcaaagcagggtttctgaactttagctccatcagaatcacccaaaggactggttaaatcccagattgcaacacccacccccagagtttctgagcccataggtctgggatggggcctgagaatttgcatttctgacaagttcccagttgatgccaatgctccttgcctgggaaccacacttcaaaaacaactgctctggagaaataaaatgtacttttgttttgttataataattttaggtggtctggcttgatgttttctggatgcaaggctattcctgctattgtcacattccttgcctacatcctggagtgttttttgatccaatgcaagacaccccatgtttctaccacttcctcttctttgtctttatttttattactgcactaacacatcgtggatattctcttccttcttgtaattttggaagctttaggttattctactgaacactgaccccctgaatctggaaatattttcttgaattatataattcagaaataaaacctttatgatttgtggtccttgtaaaagaaaaattgcaccagatggtacaggcaaaagagaatgtattcattattattgcaacagggatcaagactatgatctctctttttagagagagaactgagctccactgaatcgaaaagcaggagactcttcaagcactggggtgagctagtggcaaaattttggaggacattatagaggaaattgggtgatgtgattaggctccatgtgcttgctaattggtgctgtggaagttaggctcctatcctcccacagaaattgagagataggggctctatttttcatgatgattagatttcaaagggatggctcccaggtacctaagaaagagcttcctggattgtaaaagtggcaagaggctaggagatttacatctcaaaggagcataaatgttctaagtatagggaggtgaggagcctctagtctggaagaaaccagtgaaaagtttggtcaagctgaggggaacattaaggtcatcttccttaccattgctcaccatttagtctggtaccttatattttacaaaagggtatgttgaggtctaaagtagtcacttcctgaagaaaacacagctagtaagtggcagaaccagaattaaaacccagtatccttcctccttgggaagtatccttcctccctgggaatgttccctctgctccaagggaatctgcctatgtccttccccttctgccctgtcctttcctggcttttcattttgttttgacttgtgatctctttttctatcttttgtcatgtttcccattttcttttttctgcttttctcttgagggttcacctgagtccctcacctagccacttggatgtcttcttttttctcctccctgtggctaccccctagggttcagcttcagtttctgagctttccactgtgagtagcatggaattttaatctagtatctcctagaacttggcacaggcttggtcagggccctggcccccgtctgtgccttgcttaaatgataagaagatgaacatgacctacaggcttagagagccatctgtggagtcaagttgcctgggtttgagcttggattctgccacaaactgagctttgggaaatttaacatatctgaagatcagttctcatcttcaaaatgaggctgctgtaaaagttagattagacaattcttatagagaaactagcacagtgattgtcacatatgcatactgtataaatatttgtcatggttatcattaaacctctgaagaaagggaatcagaaatacttttaactctcagccattctaaatctcaaaagttctcaaatatcaatttcattttttaaaaaatctttgaacacttccagtcccttgccttttagtagcatttgtgttttatcacaaactttagcaacactggctgtgtgtggaatatggctctccctggccttggtgattgatgtttacatgctggtcaaagccagtcagaagggccagttagtaaatcctggccatatgttgattgctgagccatccttttgaagaggtttgactttattttcatctttgcatgtgcagagaatttaagccaaatttaggtttccttccttcctttaacctgtggaatcaaatcatttacattgtcttctcatttctcctattgatgctgctttttttttccctcaggtaagggaagggtataatgttgtaaatcagtgattaatggccatccttctaaaaccaaaattaaattactctttggattggattgtgacacttcagtctgtctgcatcaacccatccctcctaacacacacactcatgccatcactggcttatagctcaaatctgagttaggacgtgctcccttggccccaactctttttcagtgcctagcccctcagtctggagatgagctgaatcatgtttgcataacattaaataccttggtacaggaggttttgttgttgaattgtttacattgttgctgttgactctagtgtcaaatgtgtaacgtagcatcaaattatacacagcaggtccataaacacacactacagtctgcattgggaatatgaccacagagtcataatttcagtgatatagtctcaaaactattattagcattttcaatattctttttacattttttattttttctccccatgccttattcgtagccccatgagcattctaaaccacttagatggagcatcctgaattgacataaaactatcactattaataatcaagtcatggggaaagcaagagaagatgcccaactgagaacacttgtgacaggccatggtatatgcatacgtacaatttcaagtggcaatgtggggtcgtgattaaagcttgagctatagatcagtctgcacagaccaaattccagctctgccattatctagctatatctagctgacctgaattacctaacttccttttacttcagttttcctatctgtagaggcagtattagtcatcatttaagtgtttattcaagtgcttacgcatactaagttgtcaataaatattatcattcttctaaagattatcatgctctccaattgcccctcttctctgcacttacatgttatgttcctatcacttattttaaaagaactccagtttaatttaagggcatattgtagaatcttgaaaagagtgttagtgatggattatatattttgactttaataatacataagaatgcatttttaataacataatcaatagtgtaggctgatgatttaatcaacctcgtgtactacattcttgcaacctgtgatattacacaagtaatctattagtttgaatttgcagtaatataaattttacttagtgtgttttctcttggcttctctggttaatacctagtacccagaagagctgtggttaagggtactggggttgcttgtctcttgctgtagtgaaatgccagtgagtgcccaatggatatattgggatatgtttctatttttatccataaatggtgggacagaagagattgttagattcaccttaggggcttctgcacactgttcctgttacctgtgtgtttgaaaaattcagaatccataaacatcacgattattttactattctgtgtcatttaaaggatactcagtcattataaggccaagccctctttggtccacctcttagctatattgataagacttcttcaaatatgtaaaattcaatgcagtaccataaacacttaaatatattacattaataataataataataataataataataataataatgcccaccatctatttgattccttgcctttttttttttttttttttttttgacggagtctgactctgtcgcccaggctggagtgcagtggtgcaatctcggctcactgcaacctccacctcccaggttcaagcgattctcctgcgtcagcctcctgagtagatgggactacaggcacgtgccaccacgcccagctaattttctgtatttttagtagagatggggtttcaccatattggccaggctggtctcaatctcctgaccttgtgatccacctgccttggcctcccaaagtgctgggattacaggcgtgaaccactgtgcccagcccatccttttttttttttttttaaatccttaatatctaaagtttcaactttacacacaaaaataataacattcaatggtttaaagttgcctctggtcagatggttagaaaaagtcagtgtcctgattcatctttgtctccctgacactcaatcacattctgctaaaccatgccactccttaaaagggatcctatttgattttgaaatgtgtttgctcatatacactatgatcccaggtcttctactcacacatgaaggtaaaagattatttatgactaggccccttcagacttcagctgtataggtgtcggagaaccagtacttcagaaccatgcacatgaacttcacatcatagggctcttccttaagctgcagtctctttaaccacaatccctgtcattttattcatatttttcagcttagtaagacatttccatggtactaactacttggggatataggagggatttttcaggtactgagttcagagctttagggtaccctttaccagtttatcaccctagtagtttgtgaaaaggctgagagaaagttctcattcttaattcctcttttcccagaaaattgacacacttgaaaaataagtagcaaatatttcaataaaatatgaggccaaaatatgagaggggcattagttaatctcatcctacagcatgcgtctcaaattctttaatgatgtgtcgcagaaaagtgagcatttagactcagattggtgctttctctcatctctgtgtgttcaatgatttgttgattgtatccctatgccaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggtgagttactacctgctttatcagggacacaaggctttcagatgtttgttcttatgtttgatcttatgaatttgctagcaagtattctgaaaattcctgaacaggaaagctagttgcatgaactgttatgaagcatttttgtttagaaagagcagatttacagcagtatctataactctatatttatatcttcatatcaatatctatattgatgtatagatatagatatttccagaagcatccacttttctgtcttttttcttttactatggtgtctctcatgcatgcttaagagctaagacgagagaaaatggtgtgatgagttgggatatactaattaaaactttgtgtttgtcaatctaaatccccagttagcttgtattatgtcaaaagtgtttttgcatccaaggatctttctggaattgaagtatcagttgagacatatagtgaccattaactctagaagttgctttttaaccttagaatttcagccagctcctatgaaaggaataagaaacagcagtggcgaagagaatacagagagaaaattattatgtattttagaaatgtcaggcttagactgattttggtggggtttagaaaattgttcattttatgattacggtttcttctgtgatgaatggccattggttctttaattttgcatttttctagtgggtcagttgacttccacattgatttcaaaagactgagggcactgagattctaacatcagccaatgaactcaggaacatctgccaatttgcaggggaaacttctcaacccggggcatttttgtctctggccccaaggccattccgcaatatctggagacattttgattattatgacctggggagaagagggctgctattgacacccagtaggtagagtacagaaatgctgctaaacatcccccaaggcctaggacagacttccacagcagaagattatccggaacaaaatgttggtggtaccatggttgagaatccccggcttagaaagcttgacattgactagtcacttcttaagatgtctttattagagactggcaataaatggagttgtcttgaaagagatctgaagtttggtttcgatccttccagactatttcttcaattagctaaactcaaaaatgcaaaactggataagtatctcataaaaattatctgactcaatcttctcacaaatgtaatgctactagtaattaggaaattcagagaaatatgagaactgtagtaaaatagttacttgaataattgccacattttcataaaacatatggcacattcccaagtcatggtgtttgattgagacatattgaaaatgccataagcttgagggaagaaaggcataatcattttattgaaaaccgtttgaaagcttcagattagatatttctaaggaggatttttagattgcttttattttatctggattattgtaagcactataaagaaaatcaaaagaacactaggatcatattctttactttgggcactaatcaaagtactgtctgactttgttggcttaaattctttcacttttaattgagatagagggcttgcagaaaagagaacattttaaccacttgttttgagtggtttgttttaagcaaaattacagagtgttttgaaaaagctcaacagagtatttttagggtacaatgcaggaatattatttgtaatgacagcatagttgtgcatgtgtatgtgtatattatcatctataatcttgtttgtagaaaaaagaaacagaatgttgtttgatgccaagtcccaattctttttcattggaccgagtcatttagagctgttatcaaaatatctcttttgtaaaaggatcccagctaaggaaaaggatttaataacactgttgaacagcttctccatacatatttttctgatctgacaaatgctaaatttaaaatatcctaaaccaaaaggaaatgtatgcatatattgtatactatacaatgagatgcagggtgaattatgtttcttcttttctagaatatatttattttgtaaattgaaaaatatgcacatgtatgtgtatgtacatatatgcattatatataatgcatgttatatatatataggtctatctttagtatatgtatgtgtgtgatgtacgtgtatctacctatcaaatttcttatatgacttttactgttgaagctaaaggtttgcctcctctgggctggaactcatctttttctgtcattgctgtgaatctagaaactacacctctcaccctttttaaagtatctttctgccaagtacacaacagaaatacttgggtgttaggaaccaagattgtatgactattttgcttctcatttgaactgcccttgggctcatttcctttttacaaccatacttagaagctgttgtgcagaggagccatacttagttattttattttatttgttgcttctccagaatggataaaaaagtcttaggcactgtactggtgctcaataattacatcattattgaaggaatatctactacccattatatatgtgggatggataatggagcagtttttcagctaatgtcatatatttggaatgtcgttcatgtgcaaaattataattgataaaacatctgttttaagcaagaataagacaagtaatgatttaaaaatactaaggtatctgccaatcatgtgcctactaaatgaaaaaaaaatgaaacttcctttgtcagcacaattgacttggctcttactaagtactaaatatttggcacactgaaatcaacctactcacatatacccttgcagtttccccaatataaccataacttttaattttgtctggcctcagactcagctttcaacaggtccatttctaacttaggacctcttgcctgttctttctttgcttttcaggcatctggatgagtgaggtgtcacggaggctgtttttcaaagttgtccctgtataacattttcattcttccaaggcaagcctggaatcttgggtttgatcttcctctggttgtcttggacctagcctccttttggaaatttttagcagaaagctcagctttgttgggctattttacttcaactcagtgcaatccagaaatgtcaacaggcattggcatccctcaaaaacttgttaatgttcatatatgttattttgatatttttcttggccattatctggtgcaagttcaagactgtgttatataaagtcatgccatttgcagtgacttcactttgaggagccttttagagctgttctctttcaaatgcttctgatggacttccataattctatatttttatttttatcaggacttctagcatctattaatccaaactgcttacactttttttttattaaatgaatcatgaattttgtgttctgtctataaatgtatctttgcaaggtctaagttaatccttgtctatccataatcagtagctcccttataatttaactatcatcttctaaagactaggaaaagaaaatctctttctctcaccccttctctctctttttaaataattacctttcttgacagaagggtaaattcagaaatgctttggtgttcaaaaccaagagcgcatgattacttcacttcttgtgtgaattgccctttggttcatttctttgtgaggagggtccatgcttattttttatttgcttttttttttttcctttcctgagattgatggcaaggtcttaggcactgtgcaggtgctcaataattacattattattgaaataatatctactacccattatgcatgttgatgtggatagtaaagcagtttttcacctaatgtcatatattggagagaaatgagcattctgcatttaatccttttctctgcgcctgctctgcattcaaagtgccccggcttatttctgtcattgcactctcttcacctatgccagcacccatgccaaggcctgctgagcgtgcttgtgcagtttctgacgtgaaaacctcctctaggctaactaggccgagggccagccagtccgtttttcctctttagtcttcggcagctgtcattcaaactaattgcttgtattcagtgtaattgcatctggattggtagaaatcatggaatatagagaggctgtcattgcctgaattgaaaaccaatcgtcacctatcccgggtctcttaggaaattgcttttgttctgttctctagcatccatcttcttttatgtttctcagttctttccatctccccttggtgagcataaaaatcaattttttgtactcccttctctttccagaagaacctgccatctctctctacttaagcgaatccttagtgctttttctgtgcaattatttagaaacatctccttcttctagcccacagcatattaatcatatttcaaatggaggacctagaatttatcaaaagacacatgaatattttgggattatattttaaaattctagttatgatcagtttttcatacttccttagttttcattggggtaaatcaaaagccatacagaaatatagtaaaaatcctttctttttcctttccattgtgcatgtacatgtgtatgtgcgtatgtgtgtgtggctgtgtgtgtgcacagcatgagacttattttgaaataattccagatggagtcgtatgcctgtctctctgattttttaacaaaagttaagtacttacaatttttatcttgtctttttaaaatatagaacaaatgaaacacaagaaaattaaagattagaacactaaatggacttacacattttttaatattgagcttttaaaaatcattttccaaattgctgatttgggaggaaaaatgggttgcagttttgaagctagaagaaagttatttttcaaaaagaatattcatttaaaacaataaaatgcatctacgtgataggaaaacaagtgcctggaaaatgaagaacatagaaaaaagagagagcaagaccaaacagttgattttgtcactgttttgcaaatataattctggcacatttgcttccccatcacagcacattattgttggttatgaaacagatcagaatttagatatgtttctgaatatgcaacattcaaagtttcttgttactaacacacaaatatatttgcactcaaaatttgtggtaataatgggaaatactaacctctggttgccattcgtaagtgagctgaagttaaggcttttgctctctacgagtgagcatgttgtttggccttactacaatctcagcattttcctccccaacctgctccattttactttcctaatttattgagctatacaatatataggcgaagtgcatgacctgcacacatctgaagtccagaccttaataaatttttgcgtatatgaaaatcagtgtgacttcactcagaatgagacctagagtatatctagtcttcctatcagtttcctcaggctctcccagaagtactgatttcctttatttagaatattcacttagctaattagcttagttcccatgttataacagtctgttcttgtatgaatatcgtatgtactttttttcactagaatgtctcgttttctctgggtcagtttttaaattctttacctgtctgtcttccttttttatttttctttttaagacagggtctcactctgtcacccaggctggagtgcagtggcacaatcttagctcacaacaacctctctcctgggatccagtgatcctcccacctcagcctcctgtggaaccacaggtgtgcaccaccatgtccagctaattttttgtattttttttagagacagagttttgcccggttgcccaggctggtcttgaacttctgagctcaagcaatctacccaccttgacctcccaaagtgctaggattataggcatgagccaccatgcctgtcccttgctcccttttgttgcaaatttttctcatatgactgatgatccttggttgttctttatttatattgttgaagaataaggctgttgttctttcctctgccatcacacgcttcttaccctggataagaatgctcatgcaagccttatgtatcagaacaatgtatggactgagatgctttagaacatgtgctagggcagagctcagcatgctgcctccaccatctcccttatgccaagataaggaggactttccactgaaatatcaaccccatcctgggagccccattctctctaagtattttgctcaggttcctagagaatatttctgtgacttcaacttgtgaacaaatattcccactgctccttttccaatagggttacaggatttactgaaaagggaagaaaagactcacaagtagttcaatgaacagtttgcctatccattccctcatgttctgatgcttctcattatttatctgccaatactgggtgttacttcaccttgaaacatgtccttcacctcacctgacttctcattcattgattaataattttcagttacgacacattttttttcatcgttacccagttgttccatgtactcattatgtaaaattggataattcacttcagttatttggcataatggaaagtgaatagactttgaagtcttactgaccagggtcattttctagttctctcacttactgtttttttatatttctgaataggttgcttggtccccctgactcctaatttctttagagtggaaatgagaatatacctctgcaggttgttaggagagctaagatcatacatgtaaggtgcctgttactgtgcttgccacatagaaaatcggtttgttctctcctttatgcccccacacccgctccttgactgcactttgctcttctcctttcagctttttattcccataatttttccaggaatggagcttcattttctcttctgaaaaacagagaaatgatacctttcttcctcacaggaattgtgatgaggctcaaatgatgctattttgtaaactataaaatactcctcaaagacaaagcaatactatgacgaatagcagtattaataatagtaaaccatgccattatttcataaggcaaaagaatatatattagcttttccattacaagatgattctgtgatgtactacttttaaaatctaaaaccccgggtatccttgcttatgtctatttcgagaaatgagtgaatggatatgttatgttccattgtatatttattggaagaactgataatgattctgaattggtgacaaggcttagtagcagcaaaataaatgtattggtaaataacttgtgactgaatgtagctggaggtgtgtaactggaaagcagccgttatccttcagtgtatgttatctcactaatggctgtgaggtgcagtgcagcaaaacatctagctttgtgaagattgcttctccacaggtctctctactgggtacctccgtccacagatacatttagctttggcaaagctccctgaagggggtcgatttatttgctgcttcttaaattgctatgggctcccactgtcacctagcttaagcgatgggtcacaaacagtaaggtcttcacattggtgaaggttttggggtcttagatttccactgccctgcccctttactttaggttactttttgagtatctaacagagtggttcttcatgtcaaaggagagattgagaagcttacctggactaagttctgattccattgcaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcaggtagggggctggttggaaggcagggaagggaagtaccctgagatgaaggctacatagtcctcagagcagcagagaatcagggagaagcgtatattttacactcaagcctcacaaataaaacctggcagcatagagttctttgcagattgacaggattttatctgaatccttaagtttagatagaggtgagtgccccatgcagtaacttgcaagttgaaggcatgaaagtagggagaataaatgattttttcttaggtctaaatgccctttttttaaatgtatggaggaggctctctcagagactgaactctaggtctttgcgtcaccttcctcccccattcccgtcacagatcaaatgctcatgtctgcaaagagtcaatactgaattcttcatcaatgggaagaacagaaatcagtcaattccagggaggactggctgttcctacatactcctcttagagagatgcggagctgccctcctttgctgggaagacacagatgcgtccatagaaacctgaagtgtttctggtaggctgctagagtgaaactcattttaaattcttgatattacttatttgttttggggcagtattttcagacccagaggatctaaccaacaatatcaaacgtacatcagtaacttcttaaagaaataatcactaagtgcaaatgagcctctctcaaatgtgtctggctctggtctttcagagccttgactttcctttggtggctagttcccctctctggagtgcactgaacctagagagcctatgaaggacagtggtgtgcatcttgtgagatttcaaccccagtgcttttctgtcagctgatcaattttttctttcctccagtctgtccaggggctgcaggcttcctcccagtcagtgcaatatccagcagtctcttttcctccccagcacctcctacctgtgtctccaacgcagcactttcccatggtactgtattatgtgtatatgactttttcccctaggaaagcatattctctgattttactacttttttgtgtgccactggctgacactggggtgggtgccctgggctgactgtgagggggtatgtgcgaatgtctcatttctgaacattacagcccatctctgcaaaacaatggtttcctttctgtcatctgtctgtcccatgctgagtgcttctgtggtctgttacccttttcagagtataccagcaaagaaggaactgaatgccttcagagttagaaatcaggaacagagagatacaggaactttgcatgagggttcgggaaagatctcaaggatggtgttgggatgggaaccattatcaccctatgctcctgatgtaggtgcccccgcaattccaatctcccaattttctttcatttttccctcaagtcaccaggtcattttgagcaacagcttaaaggatgaacattgctcctaaattttagatcaggccagtgaataaatactccctcatatagtaatataatcccacccagcctgttggtgatactggtcctggctccatctttgcaacagcactggggatgatgagtatagttggttctgccttatgggtgttctcgagaggcaaattctgtggtttctgctgggaagacaagctgacccttcaggacagaacatcaagccttccttgtgtgcaacaccaccctgaggagcctgtgccttcagtggaaaaataatttgtttccattgaaagagaaatatttggatcaaaatttttgtcatctctgactctcttgggatgattaaaacctgatttgtcatgttgtgttctcttgttatgttctggctgaagaattattttattttattttttccaaattgtacttcctgtctctcccacaactccaagaatgtgtcctgtgtctgcctcagagtgcctctcttattaccaagctgatcctgtgaattccctcatttatttccatgacttgcagagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacaggtaggtgtgcttcctcatgcctgtgacctacagctgatttctgatgcattttgacctttatctttctatgtagaaaataaccagattcactccctcttccctttctagtctatattaatattcctcaccaacaggaagtagtatattttttcatgcatcagttgttcaaagttatagggctcagaaagtgagttgaatgaaactgatccaactgcccatgaaaacaacaggggaatatcccattttccaggctgctggtacagagaccataagaaagcattccctcccatgtgatatccagctcaggggattgcctaggaaggaaaagccttggggaagggaaaggtctgcacctaggagactttcaatactctcttgctgctgccccaaaaatgcattctttcctttcttatcaattctcaagcattttctggggctaatctgctgctccaggcaggagctcctctatgaatataaaggaggaaggtaagctgatatccacagtccttttctctccctaaggggaagcagagctcacacatctctcacaggtagccattaatcatatttaattgacttgagcatgtaagacaccacagatcactgatttttactgtcttctcaaagactgattatgtgttactgttcaccaccaaacatctctggtactctcttgggtatcccttgcagaagattagaagtgattactgtcaagatataaaatgcacagaggcattttctggtccattttcaaggcacaccgatcccaagaaaattccatcctaattatgaagtattgcattggatgagctgtttaaagtgcagtgtcaccttcgtatcatttgtttcactgccttaacatcttgaataaattattttcttttcaagccacacaaaaccctctaccaagaaataattgtcactaaattgttcattttattttgagtgattaattaatagttcatcttcagttgccttctctgtaatatctcttcagaagtgggatcttaaaagatgtgtaaaataagtttaagttacaggagaaagggcttcattaaagtattaatacttttaccaataaattaataacttcaagcttaattattgggaaaaataatttagctcttttggcctaaaaagcgtttaagtgtccttactaatttctgctgtcaaacaaaatgtaagcagaatgtttaattaaagatctttaaaataaataaataaataaatgaaaaattagccaggcttagtggctcagacctttaacccctgcactttggggggctgaggcaaaaggactacttgagcctgggagttcgagaccagcctgcacaatatagggagacttcatctctgcaaagaattaaaaaaaaaaatagctgggtgtggtggcacattcttgtggtcctacctatttgggaggctgaggtgggagaatcgcttgagcctgggatgtcaaggctgcagtgagccatgatgatatctctacactccagcctaggaaacaatgcaagaccctatctcagaaaatgaaataaatgagtaaataagtagataaatattttaataggaaagtctttcttcactgaaggaatttcaatattaatccactgcagaaacaaaagcaattcataacccctcttgtgtctgtgacagaaatactttcattccttctttaacagatttttaaaaagatagaaagagagggagataaaacaggtgtccatggttcataatcagtctagacatttatgaacttctttttgaagaatcacagataaaggtataggctataacccatagtaactttcaatttagtaaacattttaaaatctgattacccaactatggaacaatggaaataacttagttcagattcagcccacaaatatgtggaaatatgttaaatttctgcagaaaatgaatctatttaataaatgtaaaggtcgatttcatctgactcatcatgtatgcttcctaaatgcccactggaaaggtgaagtgaaaagcacatggacgagacaaagagggatttgaagaagggaaatgggagaagtgcatattttttatagtttcttctttcttttctcttctaatccactcctttttggattctccatattttaacatgattggctgaaaatatacatttctgagctttggggctattcttactcctttctcccttcacctctctcctttcaaacctttcatactgatcttttaaaagattgctgttaacctggctttctttccatcctctctaagagaggatgaggttagaccaagatctcatttgcttcatccggttggggatcatagttcctaagagctaaccaaagcgccaccttggagtggcgctggattcaagtagccaaatctctagcacagcttgtgaaggtatcacagaagctatgtctggggaaaagaaaaaaaacaaaacaaacaacaacaaaaattgagttcaaaatttttttccatgcagctgtacttttattgtaaccattagtcctcatcagaacatttttaagtataaattccttcatccctgaggatattttatgttttatattgaacataagaagggagatcaaggaatagatatcacattcatgagcttacatttaagcaagacagtcttttctaaaggaacaaaacgctatttcctaaaagacatgtaaatataaatgctgacaaataaattagatgaaagttgttcctatttttaatattgggaggcatctgatgcataatggtagtcatctttaataccaccaaagtttgccagagcatagctaaatgctattattactccagaattatttgttttttattgttataaactgcctgacaaaaaagagagaagtagtaagagcgaatcactataagcaaggtatacaatgacttagttgccagatactgacccaagattgctttagactcattcagcctcttgcccttgaatatccatatgttatgtagccacagttataattcatcatgattccatgaaattgcagagctacaggttcacacagattaagttatattttgttcccactttatcctcaggcagcaaaatatgttacatatgtttcaacagcaatattgaaatagaaaagtgtttcctattagacctgagcaaatcagaaaacaaaataaccatgaaaatcacagttctcaaataattgacttgtaattttatcctatgtatataatgtttgtaggcggtctactagggtacttcagttgttattttagagaatatgataggcgaaaactcagaagcccagagatagaaaataattaactaagatcagtaagaaagtgaccttaatataaatgaactgaggcaggcaaagaagtctatcagatcaggaaacatttgatttggatcataatcaaataatcagaataattttattcattctcagtcataagaaagttaagaaggtagcataaacaacatttttatcatattttcccttttagattgaacatacttttttgaatagtggtgtgtaccaatcattctgcaatgtgctttgatagactaccatatttcatgattgcattctctgctccttttaggctacagatcagcagttttcatgtttcacccctgtttccattagaaaagcaattcaagttagatataatatttaaaatgtaggttttcgttgttgatgataactgtttcactctctcttgtttcatctaaaaaacacaaaagtcttgttttaaaacaaccattgtatgatcacgactaggtcagcaattgagcaggatttatcacagatggctcatctctgctccatatggctggggtggcttgactagggctacacttacatgcctggaactggagggtaaccagtcaattgggggtacctgtgttccccacatggcctttttctgcagcagaatagtctagacttctttatctcttggctgggttccccgcctacagacgtggaagctgcaagtcttctttaggatcagacttgaaagactcagacatcatttctgcctcatggcgttggtaaaagaaagtcacagaaccagctcagatttaagtttgggaaatggattttgcctctttacgggagaagtagcatgcacatacacataggcatgggagaagtttgcggtggccatcttcacaacctaccacaattataagacgaaagcatattttaagtttaaaaatttacattatctacattttcattctctgctttcttcctcctttcttccacagatgcctgtatattattacccatctggtcagtaccctacctcaaccacgcaacagtaccggcccatggccccggttcagtacaacgctcagaggagtcaacagatgccacaggcagcacagcaagcaggtacttggaatctgtttcccatttgcttctcaacccagttatttttgctggtgaatcttgtactctttggatgagtgtccaagcttggcaatttaaaccagcacattttctctacccagagaagataacaaagcatttgattgactctgtgtggaaaagtagtaggtacaagaaggtgaagcatatgtcagactagcatccctggcatgcatgttaaacagtctccataaattattttttgatccttcttctgttaaagcagaaagtcaaccatgtccgtacctttctagttcataccttcttttaattttttttttcttttcaatttgaagagagtgcttcctctgttcttaaggctagggaaccaaattaggttgtttcaatatcgtgctaaaagatactgcctttagaagaaggctattgacaatccagcgtgtctcggtggaactctgactccatggttcactttcatgatggccacatgcctcctgcccagagcccggcagccactgtgcagtgggaaggggggccgatacactgtacgagagtgagtagcaggtctcacagtgaaccggtctctttccctactgtgtcacactcctaatggaatgccgttatccaaagagcagcacgaacccgacagggctgagtggcttgtgctagggagaggtttgtgtcattcctgctgaccaaactgcaggaaaaactgctaattgtcatgctgaagactgcctgacggggagactctgccttctgtaagtaggtcatgtaaagagcacgtgctccttgctgctactcatagatgcctgctccgtgatctgatttctgcactgaatctatgttatgcatatggaatgtatacagatacatgtatgtaatatatacacaatatgtaccatttttataacctatgagaaaagtgcagttcttgccaaggattagcaccaatcacagacatcctaagaataccaatgctgacactgctagcatcctgtcagattggagaaagaattaaattcccccgtattgtggatggttacatgttctttggtttatctcatggcctatttaaagtctgtgggagaagaattagagaaacctatatcttccagccagattttgtcttgtttcagcactgtattagtttggggaagaatatatttgacctctgaattgactttagacttttacagtgttttgagaacactaaagggtttcaaataactatttatttttaaaaaatcacttggcaatattttctctaatttgtggaaaacgttattacctttatcattttggtggtaacggtgctatcagtttagatacatgctgtagaaatgtgttgcttgcattctggactatcttattttatgctaacgttaattaaagggttaatttacaatcttgaggatcttggtttagaggctatgtgcaagttttctacttggttactaatgcctttagaagaaaaaagatgcagatatctaattataatgatttttattaggtttggtgccattgtgtggcaatttttaaagagattatttcagtcttgtggtagagtgtcatcatacaaagaaacgcagttacaaaacatgctgcaatccactaaacccataaactctagatctatgtgaggggatgagaaagttagatgaatatgataactgggcaacagaattagatttcaaaaaagtttaggcctcccccactgacttctccattgctttttctcctcttcactaactttgttagtggatgtcaaaacaagagacaatatatgaggcattttttactctttaataaagcacaatgggagaatttagggatgtggaaacaccctctcccattcagttagagacctcactggctccacctacattccatggcaacctggtagctttggtttgtcacattctcccacatcaccgcaaaaatgaccctcccaaggtaagataatgacactgtaatgagaagagtgcactctagagcagcatcaagctaaatatagaagcaaggcagtgcctagggtgtcaaggaagtgagtgccagttaatgtggcctgtacagggtgaggaagtgagaaaagtgaaatgatcataaacagtattgtccccagaaatgatggcattagtatacacatgcacactgagacctttgggctcttagtttttgtgaccaccacactggatacctggcctaaaatcccaacacagtttccaccacagtgatgaatgtacctagtatttgggaaagcagatggtgttccctgaccttacagagaatcacttctgctaataaaatccaagtaaccagaccacacagtggctctttgagagtgcacagaggctctgggtcctacagctgggcgtccttttgttgagcctagggagactaacagaaactttccaaatggtcatggcagtcatttgtgagagcaactctatgtggatggactatctcatagaggaaagagcctcttcagataactgtataagttatattttctggaagaactagaaaataagacttctccatctttaagtcaaactatgggctactatcagcatgtcaccctcccacagtcatgttttaacttgttcttcctcctgcctcctgcagctgtgtgtcttgggatctgacccttttccatcttcatctgataatgacaccagattatgtcataacatcctcagctatcacgtggttaaaattagagtgagacagaattatgtcagttaaagtcaaatgagattttaatctgaatttgcttcttggcgctgttcttaatctttatttaattgcagtaaaaagcctctcttccttctcctacattcttgccagaattgaaatctctgtcagttactacatctttcctaagacttaaaactctacacagtgaatttttgtaaagtgaactggacactatactgttgattaaataggacacctgagttcccctgtggcacagtagggagacataagttctttatcctggtgattttgtactcttcatccgatcagcacatggtaaaaggtcctaaacatgtggaagaggaagcctatgttggtggtaattataaataaagaacactaatgttggggccaggtgtggtggctcacacctataatcccagcactttgggaggtggaggcaggtggatcacctgaggtcaggagctcgagaccagcctgaccaacagggtgaaaccccgtctctactaaaaaatatataaaaattagctgggcatggtggcgggtgcctgtaatcccagctacttggggaggctgaggcaggagaatcgcttgaacctgggaggtggaggtggcagtgagtcgagattgcaccattgcactccaaatccagcctgggcaacagagcaagactccatctaaaaaaaaaaaaaaaaaaagaacactaatgtcgagaaagtttagagaaatcaaatggtggagttgcaaaatgatatttggaatttgtagctacatttgtgagaaaaataaaaaaccttcaatttacaaatatctccaacagaagaatccgtttattgccaatctggcattatcaggtacctccaatagtggggagatggttttctttctgagggaattattgatagcccaagtctgtgtggaagagcagttatcaggataggtgcacggcctcattagccaggcatggtggtacttgccagtagtcccagcaacttggaggagtacaaaatcacgaggataaagaacttatgtctccctactctgcctcaggggaactcagatttcctatttaatcaatagtatagtgtccagttcactttataaaaattcattgtgtagagttttaagtcctgaggtgagaggattgcttgagcctgggaggttgagactgcagtgagccatgatcatgccattgcactccagcctaggtgacagagcgaggccctgtgaaaaaagaaaaagaaagaaggaggaaagaaagaaagaaaaagaaagaaagaaagagagagagagagagggagggaaggaggaaggaagaaaggaaggaaggaaaagaaagaaagacagaaagagaaaggagagagagaaagaaaaggaagaaggaaggaagaaagaaagaaagaaagaaagaaagaaagaaagaaagaaagaagaaagaaagaaagaaaagaaagaaagggagaaaggagagagagaaagaacagaacagaaaagaaaagaaagaaagaaagaaagagagagagagggagggaggaaggaataaaggaaggaaggaaggaaaagaaagaaagaaagagaaaggagagagagaaagaaagaaaaggaggaaggaaggaaggaagaaagaaagaaagaaagaaaaagaaagaaagaaagaaaagaaagggagaaaggagagagagaaagaaaaggaaagaaagaaagaaaaagaaaagaaagggagaaaggagagagaaagaaaagagaaagaaagagaaagaaagaaagaaaagaaagaaaaagaaagagagagagggagagagggagggaaggaaggaagaaaggaaggaaggaaagaaagaggaaagaaaagcagttatcagcttatggcttgtttataaaaagactgtaattttaaaatcattctatctttggaagacttggaagtgagaatatcttaactggaaacagagtttctcaaccttcagatattgaaatgaagtgttgatgaacaaacatttcattccttaatgttttaagtttattttagtagttagctctcatgccatttttttagttagtacctgtgttgctatggttttgttcttgttgagaaacatatttaaggccacaaaaatattagcaattatcacatctcccattgactcgggatctctagtgggctagtttaatcactaccacaagtttgcaagggaaatacaccgttccttctttacagataggtgaaactattgctcagggaggtgaaataaattatcctgggtctcaaggttaactgtgtagggaaaagcacccagacgtgactggttttaagcccatgtgttaagcattttattggaacaacttaaacatggttactagttttgcctttatatgctaacatggatgattgcataaaaactggcatgtgagaaataaaccagcatgcccatgttatagaggcaggtaatatttagttaattgttcaagtacacaggttgacctaaaagcagaaaatataagagccttggtcttctgcctccctactgagcttggggttccatatcactttgtagagatgatcaataacaacaaatggcagaaagcagctgagacatttacattcaaatcacacactagaaaggaaaagaaaacaaaaaagagttccttttaaatggtttccaactccaaatttcctatgaagtttgacttaaaaagaaatatacttagcttcattctcggctctccaaaatcttggtcattcctaaaagcaaaaaaaaaaaaaaaaaaaggaacttataaaatcctatgtgtgttctatgtgtgttcttaaatgggaattgggggaagaagtttggtttagtgtcagagtaacactagcctcataaaatgaatgggaaagtgttccttccctttctatttttggaaagagattgtataaaattggtactaaatcttctttaaatgtttgttagaattctccaataaatccatttgaccctagagattttcagaaacatttttttaactttgtattttaagataatttctggagattttaaattgtgagttaattttttatgattatagtattcagattatatatttaatctttgcttagtttgggtagtttgtgatcattaaggtcttcgcccatttcttccaagtggctgaatttaagagtataaaattgatagttttatttctttactatctttttgtagcttcaggatatgttgtgatatcctgtttcattcctggtatagatgatttttaacttctctctttttatttttgtcagccttgctagatttatcaattttattgaccttttccaagaactagctctgtttcattgatttttctatattgttttagcttcaatttcactgattactgacttatctttattactttattattttcttccttctgttaattttaggtttatttcgcttttttttttttttttggtggtttcttgagataagaagttagatttttaatttgagatttttttctcttttttaatgtaaatatttaatgctataaatttccctttcagtcttgctttagctgtgtcccacagattttgatatgctgtattttcgttttcattcatttgtatatatttttaaattttctctgagaccttatctttggcccgtggattatttagtggtgtgttgcttaatgccccagtgtttagagattttccttttgtcttcctgttactgattcttgattgattctgtgatagttaaataacatattctgtatgatttcagttcttataaaatttttgaggtggttttacgacccaggaaatagcctatttagttgaatgtcccataagcacttgaaaacactgggtattctgtggttgttgggtgggatggtctatatatatcagccaaatcaggttggtttattttgttgttcaggtattccgtattttttctgtttttatgtttacagttccatcagttgctgagaggtggatattcacaaccccaccataagactttctaaagccctggaatgaatttcaaggcaaaagttgcctccagtgtccctgacatgcaaagacagaggagggacttggtttttcagaccatgctatcttttagttccttttgcaattgaataagaaatgttttatcacctaaaaaaaagttaacatttcataaaaatagtctggaaggtgaaagtcctgtgaacagtgattgggctttgggtgagctgttcctataagcttctgcccgcatctctcacttgccaggctttcagccctgttgcttaatgccagtaatactactttaggtttaggtagaggagtgatgaagttgaccgtttacaaaggacagttcaacaatctgccttcctaatagaccaggagggtctatattcttgaatgccgtgaagatagaacaatacgaaatcaagacagctacatagcagagtaaagagggtaaaaaagagcatgagggaaccttaagttaaattaaattataactgcagcaaatcatttgatatggattctgaaactgtagggatgtgtctcacctctgctttataaaatcccttttctcttctaccctcccctactcccaactatctgctgaatgattcattttgggtaaaaagcagtttcatagagcattttccattaaaatgttttacttttgaaattacagttcagaaggaggccatgaaaaagaaatcctaaaaatgcatagtattgcaaaacccatgcagcttttatggggctttcttatggtgatttaatgtacctctgttctgcgtgagtaagtaagcgatactccaatctgccttgcagtagtagaattggaatttctcacggaagacaatagtggaagtctttggaattttttggaatgtctttactcactcttttcacttacatttaagataaacctcactttggactatcccttacagtctgctcaacagccagaatgagatatgagtactatgaatataaatggagtttaaatacttaattttgctaaatgaggaaagtgaggctagaaggccagtctctggtccaatgcagtctctcttgtcagagccagagagggtcttctgctactttagcacctacagaattaatgacagatacagatttcagaaactcagcaagtttattcagtctgacaaagtctgacttgtcagagtctactctgcctatgtaaactcaaaaccatctaatacctgcaagttgtaaagagagcacacaaataagaggaaacagtatctcaataatttggaaatacgtcattacctatccccactcataagaaaagaactggagattctccaactgtcagagtatgatctttttcttcccagatagagaaggtggaaatgagcctttgcaacaggcctcttgtttgttgagctaattggggaagctaacgatggatgcagataaatcaggttgcaatgaactaaaaatacatgcaaataaaagatataggaaagaatggtgagggaagaggaaaccaggtcagggaatgtatatcctgtttgttttattttgctgactgatactatgataacagtatcaatcaggaatctgcagacagcactctgaccttttggatctagatgccattgaatcaatcctgtattctacatctgaggaaacgatgtatgtttaaagagttctttggtgaagaattgtgaagttggagggggtcagcctgtcagaaatacaaactttaaaataggccagtttttgtttccctctggaacaaaaattcaaaatgcctttcaactcttcagttatagttattcaattccctctagctcttctgtacacaaatcaactctaagcctctgaagattcgtaaaaacatcttgcaaatgctatccccaagccctctcatgggagatgagaaggttactataaccagggtcctagaactttaatgtgcatggaaacccagatcttgttaaaatgcatttcagtgcagaagctctggagtgtcttgagattctacatttttagcaaactcccaggtgatgctggcgctactggtctactgttttgaaagcaatgtaataaatagtacatttttattcattgccagctcatatacaagttgttgcaaagggagaggacctacccaaattcattattttatttcacattatttgtattaggcacaattctaatatttcatagtcaacatttctaatcttgtgaattacagctagtatttagaattaatatgctaatgtttacaaatccaaattttaagaaagcatatgaatataatgtgattctataacatagcagacactcataaatgcatgaataacatgtgtacctattttcactttggtatggcaggaagtgtgtgtgtgtgtgtgtgtgtgtgtgtgtgtgtaagtgagagagagagaaagagagaatattcattttagccagatctcttggtggtttatttttcccttgtggaaaatacggtgcttcaggtaaagttgttgtgtgaatatttaaaaggctaaaacagaaatctctcaaccatctaattcaaatataaataagagcaaaactgtggttaaatattatgaaatagaatagaatgacagcctaacaaatcaattcatgtcaacatatgaatatacacattttgtgtttcaaagttcaaacacccaaggaatatgtctcagaccttttgggaaattttcaaaggtataatatgtttcaattttggtacgcctagtgatttgggaatttcaacaaatttaaaataagaatacttccatgaaagctcatttcagttgttcggatggcagaaaataaccagactgtgaaaatgtatccctatcaccctttgctcctggcagctctttccttcaatcatttcagtttactcttgaatgaataatagtggaatggacttagtggcatggctggcaggaagatatgattatctgtggaacatgtatatttgaaaagagaccaaagccacaatttcttttctgatagttcttcatagaaattcaataaatagtaacgtgtttagtttttttgttccttcttttagaagtaatgtttctgatataatagcgagctgttagtattaacagctccaagtaagaaataaggttattgcctctttaatgttgttctgaaacacatttgggatggggcaaaatgtaccttaatggaatttacaaatttatttaaccaaagcagttgagtaagggttgacagtgaattcaatatttttagcttgactgattaatgtaattgtcaatgtaattgagaaggtttttttttttttttttcaaatatcgcttttctcattctttgtgcttctgctgttcttcaccttgatttttttgctccttggggttggctggagatggggagaaggagcatcagagctgaagaaagaatgtggaatactggtatgaccaataagatgcattaatttataaacagtaggatttttgtctttataccttaatttgccttctctaagagttgatgattctttaaaaagatgtattttcctaataagttacatacattttaatatttagagtccactattctttgtaatttttatttgaggaaataggtgtaactaataacactaagagaagcaatgcaaaagttgttacacttgacagctctgaggacatgatttatactttgggtgtctgcattattatatttccaaaagcagaggggtgagttattaaagagtgacacgaggacttaattgtctgatgtctattaacatcagtgggaggagtcacatggatgaatccttgtggaacatgctgttctgaaaatattagtttgaaaaaagtttctatggaaatgttcatgtgtttctttcattaattggtctaattattccatttacaaaaatgagaatgagaagtataacactgggattaagagaaaaattaacattattaagagaaataataagaatcatgctatttttagacctaaaaatcttacacattcccaaaaacggtatagatggccaggttctctctatcccctaggaggttacagtaaaaggaatttgttcagcacatttgcagtaattgctttagcactttgtattttatgtgatttttggtgtttaaatttacatttgttatgcagttaagaactactggtattattagaattttctgtaaagatggaaagtaagacaaattatagcattatctgttttctttactatacaaaagaaagtagaaagcagtcgtttggcgaaaacagaaagaaaaaggagatttggattaaagatggcaagaaaagaaaggtggcaagtaaagcatacacatatatgttattgaaagctctagcatttctttgcagtttttctaggagacaaactaaataaaaaacaaaataaccctaaaaatttcaaactgctttttccaagaatgtgatttacctgattatttaactgaatgaaatcttgactctcccttttacttttctcctccttttgtttcttgttaattttttgagagcaatttctgttctcagttgtcacctacatctatgaactaccctgtttttcagtcccacttttcttctgaagcacatttaaaacaaacaaacaaacaaaactttttcattgtctccaccaccttcccaaacctaagtctgttttctcattgtattttctatctttaactcttgactgtacacaagttccctgcaactctctttatactctttttttctttttatattaaataaaatttgcacttcaaactcaggatgctgctcatgttatgttttagttgtctgcatttttctcttcatcagttctttttctttctattctgcacatgtctctccattatgagataggacacttcattattccagagacagtctcaatctaacagccaaataatgaagaagaatttctgggattttctccttttctagtaaaagaccacaaagagtaccatgctatttcttgttcaccgtggtatccctagagccaatgtaaatttggccctcaggatttgtgacttcacgtagcaattagttgtgacaaaagagtgaagagcatcttaagtagtgttatttttatcttgctttccaaattcagagatgcagtggtacccatgggaaaactgcaaggcttttggatggtgtttaaatttttcatttccaagaactacacatttgggtaaaaactttagtggtattccaattttgaatagaaagcagtttgcaaattgctgaacttataagacactatctcagaagtaagtacccctgaaagacgctgctttttaaaactctttcttcattctactgtctttagacatgactgcttactacagggacacaaacgcaaattcagcaaaaccaatcagcatgggctcattttactcattacctcctagtttgtctattccccagaccaacagcataagatcacagttttaatcaccccctccagctctgaaataccaagagcgcttctgtccaaatgagtggcacataaatgtaatggttccacagcaacaatcactgtaacctaggaaggctacaatactgtctgaaactcatcgaattagtataattctaaaagaaacactgtaacttaggcactctgtttagagcttatgcgagtgacagtcttatgagtgggttcactagttggttcagtagttatagtatgattccatggctgaggcatatttgcacaaacgttctttgggagagtatgttaccaacgtgcagtagccttcacatttatgctcctgtccaaagccacgaaaccaccacagaccttccccatgctttcatttaggtgctattcacagttgtcagccaatccttcctggtgggtgatagttttgatggctcttcagtgactcccaccaatccctaatcatgaggaagatgcttaatcatggggaagatgtcagccgacatcatgattcccacactgttttttacaggtacctagagacttgtaattctcccagatgctcttactgctttggggattgttttgttgttgttgttgttgttgtaataggtccagcacaattgcaccctttataagccactgtgtgtcatatttgttctgagaataaaaaataaatggcagaaagaaggtccagattaaaaccaaaagcacaccttgcagaatgcaggatattgcagtagaacacacattttgagtattgtaggaatatgcagtaaaatctgtcaagctagctccaagtaggtttgcattaatttttgtttcctaaggaaaacaacttataaacaaatatcactttcattactcatttatgcatgggcagtgttaagtagccagtggtgtggtattatgatacagagttcagagggtttgaagtgccttttagtgatttttttttttttttttgagacagggtctttctctgtcacccaggctagagtccactggcatgagaactgcagccttgaactgccgagctcaaataagcctcctaccttagcctgagtagctgggattacaagcacccgccaccacatctggctaattaaaaaaaaaaaaaattgtaaagatacggtcttgttatgttgcccaggctggtctcaaactgctgagttcaattgatccttccaccttggtctgccagaatgctggggttacaggagtgagccaccacacccagaccccttcaatgaatcttgatgaataattcaattttcccaagttaagacctagtaggtctacctgctagaaaaggctcagcttttgctgacctgggcctgtggaattgagatgagtcaaagagaacaatccaatgacaaaaaaataaatccgagaaaaaagctccagcctagctgaaaattgtagcaagaatcaggagaaagagaagacaatccaagtggtggtttttgttatgtttgttatgttttcttttatatgtagaatattttataaattgtgaaaacaatgcagtgcataaagaaggctttttgaaaagacctcaaaactttatgctaacacaacaatgaatttttagttttgactcttctctttctgcctttgagcctatgtatatatgcatgttgtagatttaaacatgtattgtgatcatagagtatcgcaatttcttatttatttggtattatatttattcaaaactcattattttacacttgattctgatttctgtgaaaattttttaaagaagtaaaactgtattttcagatttcatgtgttttacataaaaattcaaagcaattcacaaaacaactggtagaactaattagttaatttaacattgttgcagaatagagggacaatatacaggaatcaactgtgtttttacatacttgtggaaaacaaatagaaaatttaaaaattctatttataatagcaacacaattttaatagtaataattaatcacaacattcctgaccttgtggcccagggaggattagatcattgcctcattcatctgagaaccactccttgagccctagacacaaagcagtgtcttgtagagaaacagcaattacaacttgaaatatttctccatgcagtccttgctttcctgatttcctcatcaataaagaagcatatacttggggggcgggggaactaaagctttcaaatctctcatgtatcttctttagcttctacattcaacaaatatttcacaataaactttggttttgctgcttctctccccaaacaaggacaatgccatagaagtttctgagtatttttccaccttctgtcaagggcttttgtctttttaatttcccattgttaaaaatgacacaattcaaggagctcacactctttgagttggagtctacctcaagtgcctctctgaatatgctacacaaaggagacggtttccttagcaacaggaatgtgatgagaaaaaaaaaaacatggaaatatttgctccctaactccttccccagcacccttcagccctgctgtttgccaggcacagaaactacgcttttgacaagaattcaagctcctgattagtttaaccattgtctataagtccctctacaaaccacttgctctatttttttcattaatgaaaccagttcagctgtggaatggtcattttctcattagtgcctttagctgttcttttctatatatttaagtaaagcagagaaagggaaattgggttttaaaaagtgtgtgtgtgtgcatgcttatgtgtgtgtgggtggtgggtggatatatgaatgtgattgtccagataagtggattttaagtaactgatagcatttatttttacatttatttccagtctctgaaatttgcatgtaagatatattttaaactctggcaggaggcaatgacatgtttagtgacctctatgaaaagtaatgtattaatttggcagtacttatgacacacttattaagtgtgcttctgaataaacccccatgaggttaatgtggttttctctgtatattaaaaattggcaagacaaacgtaggtatatgaacttacagatagaagactctaactgaggtctaaatccagggacatcattcagcaatatggagatcaatagatgtgattttcagtcctaaatgctcgctatgcctaggaaaccaataaacccacatcatttggggtccaaagcacaaccttttcccaatacagtttgtccctctttcctgtatcttttacttactcagagcaatgacataatatgcatataccgttgttgttcatttctaaattattttactgctgagcttatcagctattgaagaatgtttggtgtgttgtagactttctctttttttcaggtaattgaacaggtaattgagccacctgttcagcttggaactttaggaatctatgagtttgccaatatatttactgtatcttattcaggaagaagtcttccgcataagtagaaaaaacaaaagaattagtatctgccatttttttctttcatttttttattttcatttttttcctttcattttctctctctgtgtgtgtgtgtgtgtgtgtgtgtgtgtgtatgacttaaacaactgaaatttattttcccacagttgtggaggctaaaagatcataattaaagcattggcagatttgatttcttccgaagcgtttctcattgatttgccaatgtctgcccattctttttaaactgaagaattaaagaaaaatattaagtgtggaaaaccaatgtgctatgccaaagtgttcttataatatggccaacaaacactaacactttggattgttttaccaccagctagcattaaccaaaatagaaacagtgatcctgtgttcttcccatgtcgagccactcggttgttgtaagaattgcagtataccttcaggaactagaaggcatatattaagcatcacattgtatcttcatgtgtatttataaatggatcttaaaaccctaaaaatgacatgccagggtttattcaagaggctgtaaaaacactaaaaagacatccaaaagctttcctttctcccccttgttgtcgttgttggtttgtagcgacagtatctgactgtaaattatgtgactcagtaatgccagctctcaggatcccagggagctgtcttcctgtctctgctcacactggtggccctcagggttggtggcattgtcttgaagactggatacttgaattctgtccatttgcctgctggtgacagccagcacttgtacgatgacaactgccatctggctctttctgctagatttgtagcagaagcctcagttgagtttgggggatgcgagattctccagggaaggaagaacctctttgaaatcaccacagatggctttatttggggaagataacaggcacagaagtagaaggaggaggtaaaaaaaaaaaatccgctgggagtttgatgtctgctcctcttaaaagaacttaagatgaacttcattgattgatcaggactgtagtatgtgcatggaagaatttggaggcattgtgaaaccaaactgaaactttaaagattttgaaattaagcagcccatcatggcactgtggatattagactttcctaaggaaatgtgtgaatgtgatgtaaatttgccatgggaaaaagtgcattttcatggttcctaaatcattgtttcttgagagatgtcccacccacattaggattggcagggtggtgaatgggcttataaaaaaaatgcagataaatggatcttcctgaatttctgagggctgggcaccaccttccccaaaagactactcagtttttgtgggaagagtgcatttctctagtctctttcaaaagcactttttttccctgactgtaacagattctaatgctcaggcagatccgcttttctaaaatgcattctcaagcaattaatatgccattaatatttaagaaccactgccctaaagctaatctactttgagaattcttctgagttttattttcttctctatgttcaaaggaatacaagttggcaagtataccactgagttcaaatcgagggcaaattttcttccacgttttcaaaggcatctaggttgtcaggaacactgtctaatacagcaaatgtttgctttctctatatttagagatgcatttggagatgattaaaactataaggtgggtgggtaggcaacgtttagatgtaggtaaggtacgtgaaaaatttgacatctggctagcagtttttggctacttttaacacaaatctattcataagacctctgtgtcttcaaaagagcttcttctttatacagtaaccccacacacatgaagacagggctgtttatttgggaacagccctcctgcaccacctctgccttgtaccttagtgtctatggaggtgacctgttgccactgtcagcaaagtttgtgctttactctgttgctaaaaaaacaaacaaacaaaaccaaacctctggttttaaagggcatatttcaatattctcagagggaaaaatatctgagtggaattaagctccagtgagattcttgattattcaatggtgaaaagtggaagctaagataagatggattcccagtatatggagactagaaggattagcacctcagtcaccagtcatctgaaagctgtgagcaaaagagcttatgtcataagttttgtttctacaggtttaatttctaagtagaagcagaacaccaactttgtagccaggcagttatttattcatttcagcaagtgtttattgagcccctactaggacggcacacattcaaggaaatctgaagacacagactggcatcattccacactgaaaccgttgatgccatccatccatgagtccattcagacctgctgtgatttttacaacatgtttaaataacaaagaattttttccaaacacatatccctcaacaccaaggtcaaaaactttataataactacacagactctctctctcctctctctctctctctctctctctctctctcacacacacacacacacacacacacacacgcttttggaatacatatcattattcttacacttaaaattttattttgtcaagagtcaattgttattcttcaaatattttcaattaaaattacagagatattctgtggtaaaaatattctcctttgtgctagtaaacaagatggactatatcttgaacatgttaaaatgatatttgtgattaatatcagagaagtgctgatattatttctgagtttttgcttatttgctttctacatagaatcaataaaattgacaactagcattgcctatatatgcaggtgtgatactattcagggtactagtatattggccactcattatgaaactttcaggtcctcatatattttcttttattacaatgatctacttatttctgataaatattggattcatagaggctaaagggctgggaaaggaaaacattcgtgactacttacaaccatttgatacgagttgtgtcaatacagacctcacacagcagacatgcagtcaatatttcttgaataagcaaatgacacacttccctaaaataacactaagtattagtaaaaatggttcaaaaaggagggttctaagacgatggttccaatttattcttaatttgaaggcaggcatatattgaggttttataaaaccctaatttagcaatgttttaatggctagaagtttaaaaccagactcagacactagagccaagtaaactgtaagacacgatcacactctgagattattcaatgctggtgaggaggggccatttctctgctgtccctcaatgccttctttcattaaacattactgattctgatgcccagacacaccaggtcttctgagtattagaagaatattttagacttttaaaatagcatctggagaattgagtcagaggctacaatggggtacataaatatagtatcagacagttaaacatggggaaccactagacaagagttctaataataatagctctgtgtgtctttttaaaaatttaattacacagctagggttgagaaaaatccttcaaaagtctctgatctaattaaatggcactcttcaggtgcgttaaaacaccattggttttgattaatagttctcttacctgcctcatttctgcctctcttgggtatctcccttacaactgggctgttgatagaaggtggaatttttacatggccttagggtgacacattagagttaatgtcatattgtgaattgaagtcccgtgaggaccacctggaactgcagtttgtgcatctggtaaattttaaaagtcttgatatgtgtttaacattcaactgtctctcattgatgtgcctcaccaaggtgtggagttgagtactggctgaccctctgccatgcttgtcaccatgcagttacaatattatggacaagagctattatctaatcccatggaaccacatggagcttggacggtcactagaatggaacaaaacccctgaaaatcctttagcggctattgtaaaattgaatagatattacagaaatgaatctggtgcattgatcttgactttgaaggcataactgactttagcggcagtttagatgtctgggtagggccatcctacagtaccagtatagaaaccatgtgttaaattgtattatttccgaagttttcatcacctttgagtatttgtagaactattcagaaaaatcttcatcaacagtaaaatttggcgatgattactttgtaactcaaatattattttcaggccgggcatggtagctcatgcctgtaatcccagtactttgggaggccaaggtgggaggatcacttgagcccaggagtttgagacccgcctgggcaacatagggaaatccccatatctccaaacaaacaaacaaccatacaaaagaaatatgattttcagagaggattgaattgctaaggatggctacaatgaaaaaaaaagtacatttagaaagaataacctgttttatgaaatgaaattaaatattagtgtctgttcctgcctcatagaagattatggcaaaagttttcacttttttggtaacctaaaaatataaggtggatgaaaaaataacatttaattttaacctctaagaaatctcttagagacacatatcttggtcaagaagaattataacagtataatatgcatgcttttgcatgataaatagcgtttttagaaatgtttacttttattatcatggctttgatttcaaatgctgacagcttgcactaaaacatttaaaagttgtcaactacataaagtgtgtggcaaaagattttatgaggtttttttcctccaagtattttcttttcttctcttcaatggctgatgtatgctcctgggcttctgagttaaatttggattcttatgtgctttcctccatgcattcccgaggtgagatactgatttatgacagtgagtggatattccgggattgaccacagaaagtgacacacctgcatcccatacttcaggtgaccttcttaagcatagttttctttggtcacaaaagagattactaaggactcagaatacagagccaaaaggcaagcctagataatgttttgtggggttttagtgttctgtttgcatatatgtatacattttgtttttctaactggttctggagagataaatgtaaggacaccacttttactaaaaaattatagttctgccatttgtatatcatagaaatacatatgcatagaggaatatagaggaattttacattcttattgagtgtggcaagcagtttaacattcattatttctaaaaccttttcacttcacaggatctgatttaatgttctatattccattgattaaatgtgaagttataacatcagaactaaaatcataagcaatacattatgttctcatgtacctactattgctaaaggacaaggaaaattctacttaggttaattattttaaatcaaaattatccgttttaagtaattgaacttatatggaatttttgcagaaattatatcatttttcacaccttactaaacaatatatacactgataatattattatttgttgttaccttaaatatcctgagcttacccttctttttcaaggtttacatctgtcaaaatgtcaaattctaagcaggattgccttgccctcatcttttttcttcttcggtaatttgtgttgagagagtgatagcaaagcttgttagaaacatgtctgagattgattctgagagatagttaagaagctcagctaagaacagaaaccaagcgagtggggtagaagggaaatgctgtaatgtgtagttaactggatcccctctttcaccctgagtccttcagtttattgcataagtgaagcatcagtatactgaaatcagccagcaagctttcttgtcagttgagcatagctgggatacaattttgcacacaccttctcgccaaggaacaaaactccaccattccaaacaaagaggtgacatgtaaatgtaaatgaagacagagtgctttcaatgcttcttaaaataaattgaaatgtaaggagtttcttcctagtgagttataaaatgagaaagatagaaaagacaaaaataagtcttttaaaataggttaacctcaataattactacatataaataatttattctacataatggaatggttaagcataagaactaaggaatttgatttcctgagttaaaatttctgccatttatatctgtgtgaccttaaacaaagtaactactttgtggctcagtgttctcatatgtaaaataaagaagatctgaggactagctcatcaaggattaaatacagtaatgcaagtgaggggcatttagtgtttgacacatagagagcaatgactgattattaatgtagctctgggtaccatgtagagcctgtacaagaaatgagcactgattctgaaaactattctaagtaccccctctattatttatgtggagtatccaataaccaatgcattcagtgatcttccacggaaatttaactctctggattttaaatgctactcacatgcaactagagtcatgtttttattctttgaaaacaaaatgggaattttgaattctattcatttggttaaatacagccacatggctctcccaagttccattctgaaactaatttgtaaatcttcacaagttggagtagtaatggcacacatacttaaggtaatgttgaatgcagcatggaggtgccaatctctttattgatgtaaacaagagaggctttgctacttaaaaaacaaaaaagaagaagaaggagaagaagcactaacacagaatgaaataatcaggtgctaatttgtttctttgcctgccctagatgccactgtatgtgaaggattatcatagaaaatgcattctttctggaattttgagcctttaggcatttgacgtgccaattgccttcacttggttgtagtctgtaatttatcactggagtgtcctaccctgctcaaacgcaccctttgtgggcagaggcaaagctaatatactctccaagtatatttgaattgcttcaataaatcacagctgccactgtaagcagttttatcatttgccagaacaataagttatcattttaccttatagatgcaatgctttccaagacttttatttgtgtaaattgtaatgcaccatcacctatttcttaaaatacaattaagaagctcatattatacatatgtgtgtgtgtgtgtgtgtgtacatgaatatataaacatattttaaggtgcaaggaagtattccaaggcaatggtgtgagcttaccaagaaatggggcattttttatcctgcttattttatagcagcaattactataatggtgtgagcattaaatgcttggaattggggttaaacttcatttagctctttactgctccagtgtctcagtgaaaccactctgtaaagaaataggactaagcacaaatcattcctgttaggcctgccatgcatgagatggagaaacctgatgttttaacatattgtccacctctactgataactctacagacagtcatttcaataaatcaagctgtggaatcaaatttttggccatagtgatctctgggacttactttcaatttcttctttatttcacgatgaccaaaccacaagtcagaatgcacctgacttaaatcctttagacttctgaggaagtaaatgtactatatgaagatatcatgtcttaagtttctaataaggcaaaaataatctaacttttatactgtttctggactctcttcaccatgatggacaataaagtgtgctcttttttgttggcctgactgaaaaactgcttaatatttataaattaatttgccatcagttcttgaatgataagaaaataattttgtttgtaattgcctcaatagttcactccaagcagagaaaagaagtctataaaaatgccaagttttataattagaaactaatttatttgtttcaaagccaagtgttttcctatgtacatggtaatatttgaattagctttaattctgtctgcatttattaacaagaagggacttatatgtcctatcatgaaatttcagacttttccatgcagctctgtcagtttgcaatggctgtttatttttatattacactccttgatagccattactaagaacttcataaacctcctcttcatgcctgactacaggatctctaacccagtgtttctaggtggtggtaccatcataaaacccttgaacaaaactcccagcccaccagtccttaaacattattattcaaatcagcatgggaactctgccatcatccccatcattcaggtgcacccatgcttttcacctcatcactcacacttacacagtttctggctctatcaacaacttccttgcttgtctgaggcctgacccaataaacgcatccagctccaggctcataccatgcccagtgccccatgcttttccgtgtgtgtgtgtgtgtgtgtgtgtgtgtgtgtgtgtgtgtgtgtgtgtgtgtgtgtgtgtttgcatgatgaatgaaggatggagaggataggcttgagatgaggattcagattctccactgttttaagtagatagaattttgcctttccccttcccatttcctcttttccccagaccctcacctcattcccttttctcttttaatccatggaaggaaagtggtttcctgttctccaggatagattcagctggcaaattctactccaaacagtaagtggaaggaggcctatcatttggaagatttggtcattttcagaaatatggaacattggctaacacggacatatagtctaaattcttttctagaaaaccaattatgtgagactatcactagtttataattactcatttaataaaataaaaataaccgatatttgatttatgatagcatcactaatttcaatagtagtgtgtctttgaagaaaagaaatatacaacaaaaggagcattacttcgtgtatgattgcttctataaggaatcccattcacaaatttgctttttactaaaaatcccattttagcatgttgagttttacatttttaaggcttaattaagcatgactcactctgatttgtcttatcactgaaaggccacctgcacccttttctaaatcattaccataatacagtgttattactataatcattttatcattaactgcttgctatttattgtcatgttatcagagtatcctttaaacactagaataacatttttaaatcctaaattcactttacaggcatagtttactaaagaattagaaatgttatatgttacagatattagaaaaggctagtatataagaatctcttctttgagtgtcaacctatgttaagcctaagtgaaaggtaatgggaaatgattatcaataatccttgaagaaatttctttctctctcttcctctctttctctctcactctctgtctatacatatgtgtatatttatgtgtatgtgtatatacatgattatatatgcatatgattatatacctatatcttgagaaagtaaaaatcatctgagaccgagaaagtagaaagctgcacagcctttcatcaggctgcagtagcagacacagattattccaggagaaaaattaacaggaaacaacatgcccgcgaagaggcactgcaaccatagggtatcataataacccttttatttgagtgactactgccctctccactcttgcctggaacacctatgttactgtaacataaagtagcagcctcaatttacaacccaagggtggagcttcaggtagacatttctgctcacaagattccacatctatcttagctttgtggttccaaaggaaataggatcctgagtctgctatgcagtctaggcaggatgttgactccttgacacagccccgctttgctttaagtctgtcaaaacactgcttcatttaaaaattatttaatggtcctgagttcgctatcttttgttgctgagataccctgtggctcctctgctttactgcctccctcattgcaaagaataataatttgtcagactgcagttttgatcttggttatcttaggttcgctaggctaacactatctctatctatccttccaagcccttttgatgataatttggagcagactttctttgttccctgcatagaaaagaacacattcccgtaactaaagccatactatcttgctaagaaacagaaaaggccatttgatatggaaacagtggtagcagagtcattgcttggaagggcatatggtggtttggcttgaaaatgtacaaacaatttattgctaactaccaaaataagaagtgtacaactcttgtgggagtgtgggagtatgtagcgacgaagaagtttcacaatccaggtgactccctacttaaagttgccatgttggtacagttaacagaatacactgcatcagtgcaaatctaaaagaagctagaagccttctccatcaaaacagttgttgactacaaaatactcattcaaaaaaacattttttatattccctgggatgaaatccaaatctattttatatgagactctgcttccctgcatagccccaaactatgcttctaaattatcttatagaaagaacatcttagttccgtagatgtctaaaattcctccttttattcatttctttttcttcatcaacttgtcctaggaaagagtgggttggtgttaccaaaggtagtttatttcaagatatatattggcaagattagtaaaatggttcagcattcttagccttggaacagtttgatgctttcatagctcaggctgcctccaatcttagaaatgtggcctttcatctcaattatctggaaactgagcattctagaatagcatatggttcttttcaccacaggcagaatttactgtttgtagtcaaacagttgctgccacatttttagaagactcttgaagaatggtctgaagacacacccagcctttagaaaagtgaatgcacttgactatgagttttcattggtgggcagtgattttcccaccttgtgtggatttcacaattgctgagcactatttttgagcttggtagatagcctgccagaagaattaaacataaaatgcttaaattgtaaacagtagcctgctgaatgtatcctatgccacaattctttatgccctaatcaacagtttgtgtcatttatgatttattctacaatgaaaggctatgttgagaatcactgcagtaatatatcattttgattagtagatggctgtttggtgcaacaaatagaatgaattactagtcaataaggaggatccaggattttcaaagtaaagcaggacaatactcatcaatattgggtaaacattaaggtcatgaattgagggagctggaagggtcatccagtactctcatttttaacctgaagaaactgcggaatagttggatatgcaccttgctcaaagctacagagctcatctgcgagtgccctggggctccacttagaaataattttctttctcttttgtcgagtgctatctctccctaggacctacagtcccacttggccagcatgggaagtcagagtgttgatggtcacagttctttgcaggctggcgtttcctgacctctgggcacattggtgaccattgcctcagagttacctgcaggttccactctctagagttaagaagtttatgtgaagtatcacataacatcagaaggtaatgattgtttttttttttttaagatgcagtctcactctgttgcccaggctggagtgcagtggcatgatctcagctcactgcaacctccacctcctgggttcaagcgattctcctgcctcagcctcctgagtagctgggactacaggcgcccatcatcatgcctggctaatttttgtatttttagtaatgacggggtttcaccatgttggccagcctcgtcttcaattcctgacctcaggtaatctgcctgccgtggcctcccaaagtgctgggattacaggcatgagccaccgtgcctggacaggaggtaatgatattttatctatcaacatttattcaacaataatacaatacatttcttaggcacctattgtgtgcaggcatcacactgcatagaatgtgcagggtaagcaaaatgtgaacagtgagacaaagataaataatatagaagtagtctcttaagggaattatagtcaagaaggaaaggaaaagtgactgaaaatcatggcataatcatataaattaaagcattttcaaaggcctttggactatattatgttcagatcaagagttttattttgtttttgttttttgtttgtttattcttaatcatgttaatgtagactgactttaacagaccttaagaaaatctaattcacatcaggcaagatttattttttttaacaacttaatatcagatttggttcaggcttaatattatctttgtaactagcaaatgtagctgttatttgaagccattaaaatactaaatttggctgcagctggttattgcacccagtcagaaatgtaaaactgatgaatttgacaagtttaatttgaagcatttgtgggcatctgctgaagtatgaagtatccgtatcagttattcttggaaatgaaatgaaaagaaagaatacttaaatggcaaacatcttccagagctgaaaaaaattgtgtcataataatatttaccaaattgtcctaataaaacagttctgtttgaattttagaatgttagactcaaaagaaatcttaaacagatccagtttagcccaggcccctagctttacagtcagattaatgatgaggaaactgaggccaaaaaaagttaagtaacctactcagagccttactactcagtaaaatgtcatgagctgatattcagtttgctgaacaattggttggtgattagtccagcactccagcactccttgttttagcagtcaggtatgttttctgcgctcagagatgagtcagcatcctcctgggtggacctcaaaatctcacattctctaccacatttccattatgcctttttcaatcccaacatgtttttcttctagtccagtgaacttactctacaagatatagtcctcctctctttttattccactttattttgggcagtcatctgtgtggcaatcacagatttattagttgcaaataaatgaaagagctttggatgcctgaaaacagctgcacaggcttgcctgggttgatgcattgatgtcagcctccgagctcagggtgtgtgccagagtctggatcagctgctcttacagaattgcactcctataacacagtctgtcattattaggttgcaattatttttgcctacagctggctatttttcatagccattttactttttatcaaagtgagataaaaaggattttgtgcttgaaaagctgctgttttggccatatcttgagcataagcattgaatttcttatcattcataggactcaagcagggtcttgaaaatgagtagaaagtatatcatcttaaggataaaacatattgttacaatataatgcatttttggtgaaccctgggagtggcgtactcttagcaggaagtgaatttcaacttcaaatcgttttttaaattataattatgggcaacttgagtgctttctatataccagacagtttgcttaagggtattacatggcttaatcttctccctgaccgtatgagattgatatcattaattgtgtcaccttccctattttacagatgatggaagtagaaatttggcaggggaagtaactgccgtaggatatacaaggagtctgtcttaaagaccaggtctttccataataaattgcctctcatgacttgacaatttatgcctacaaaatcaaacaataattgtatttacttcctccctcaaaatggtttttaccagtgttagaatgtttgcatcccctgagacatcattagatgtctagtcatggatagtaggtatcaaatagcagctctctcacacctaggtaaagtggttgtaatcatttatttttaagctactgaactatgtccttcatcatgatcttgttaataatgccaggccactaaggagttatagttcatgaaatttcatcatgtaagctttccaagggccctcacctgctgaaatgacaactttttttaattaaaattttatcctcaaaagtaacagccgtatgtgtttttttagttagttaataataaaactaattattgtgctacatcttagactacatctgttttaaatatgggcacttgtagctttgtgttctctggcatcattaacaaggcaatatcaactaagctgatgattctatcaggaggtactggggacacattttaatcagacacatttgtaaggcagtgactgtgtcccgcttttgctgtaagtcatattgatggtgaggtactaaagcttcactgctcagttaagtgttccttacaaatgtagctatggtaagatagagatcatttccaaaaatgtgcttactgacttgataacagtttaaaaatgacttcctatcaggtgcagtgctgtgcgcctatagtcccagctactcgggaggctgaggcaggaggattgcttgagcctagaagtttgatgccagcctgcgcaacatagcaaggcccttataagaaaatttcccatatgataaaaaatgtttttaaaatatggctgaaaatattactatgtgagacaaaatttatactttgggatgtcatatcaggaaaatttgcttctacattaaatttacaaagacctctccaagctgtgggttgtccctcttggatcagtcttagatgcctgaacttatctaagtgacattgaattgctctttatcaatggatatgcattctttgtgaattcttcaagctctccctccctcttctacccccttttaaatacttagaatccttctggaggagtgtattgagaagcagactccgtttgaattgtgttatacttggatgataaagaatgagttactcatctctcctgctgaattaaggattttcaattctggattcttgtgactgggtttctgggcttccagaagaaaccagagaaattttattcaaattgcttttatatgtgcctatgtacaattaagtagaaaagtggttctagagaaattttctctggagaaagtttcagagaaattttatgcaaaataacttttgtatgtggctaggtacagttaactagaaaagggcctcaatacttttatcaaatctttgatgtgatccatatttctttataaatattaaatgtcagtgtccttgatcaataatttttcttagtagtgccctgttcttcccatttcaaagatgagtgagaaaactaagcagcagttcctaaactgaggactgaaggtttctgggagtttctgctgttaaagatagtaagtaaaatatgtcaatttaaataagattaatacaaattaatataaccattctatcccaccccactccccaaagaaagaattttggaaatgctctctgagtgactggtagtagaaattcgatgagggagcatgccacaacttaatcattcatttctgtaggcactgttttgaacctaattagatgccaagctgttttaaatagttttaatcccttgtcttacactgattaacttacatgcatagtgaacaattggttaaagacaaagaaaatgagaaacaaatgcaatttatcaggagcgcagaatgaatcccatttctctaagttcatttcaacaaaactttcactgtgtttataaaaatgtatatgcatatgcatacacatgaaaacacagtgtatgtgcatatgtgtgtaaatgtacatatgtgtgtgaatgtgagtgtatatacatatgtgtgtgtatatatatgtagttactgtacaatttaccatctgagcccatccacatttgacagggaaaaagagggctattaataaataaactagagctatagccattaacagacatatctggtcatcccatataaaactggaaaatttgtgttttattaaaacaaagttaggagtcagaaagttggattggattttaatcttcattttatgcaatatattttacaatatatattaaatataagctactgattaaaaataagcaaataaattccaaaatatagagacagaaaatagtgacatttatatctcatttccttttttttgaaagaataaaggctatctataatctgtaatatgtttttctgtggataagtgcttgcagtgagcagcataaatgcttttgtcttattgatcaattagaaacaaaacacaaagatcaaaaccagccagctgactttttaaatgcataaagtgtaatattttcaaacattgtttggatattttgtctattttggtactttaacatgtctttaatttaatgtccattttactatttcttcagtccctaaagcccaacatttcaaaatatgtctgtttataaatcatatttttacataaatagaaaataaataaaacaccatttatcatttattaaatggggaaaagtaaaattgttccatgtgtgttgagaatgttattaaacattgcattttaaagaatattagaatattatcaataatatgttaattgaaatattatgctttctttaaaaaaatcacttgctcaatcttttagtgcacaaaaaatttacaaaatggttacattagaaacactgggaaagtggaagattctctatacctctgcaagggactcagatgtgttaggtactgagaagccctgtaatagtctaacaagttagaagacaagcccttcatgacagcagctggccagggaaagcagaggaagggtgggcaacattttgtgtcttatctttgatgcaatgacacggagctccacttaataagtcaccagaaaaagttggaaaggtacctgcttgaatccagagtgcactcagcacccttttgccctaggatggctttgggtgaaagacagttctcctttgatggggagaaaatgtagcctgttgtaggaagtgtaagcatagctttgattaggagacaaaggacacagtggaactgagtttattccttatatgaggacaagaaggagacctcaattttctccgaatacttggtgacacatatggagtagagcttctaactaaggaatacagcagactggctgtcctaaaattacagcccagaaatcactgctctcccagggatgggagtctgggcccaagtgcctttctaggtggttcctgcctggatatctgcttcccagttaggaccagcttgaccttccactccctgctgtatggagagttttgcctaccatcattttcagagctgcttctgccacttttgctactagggattaaaatttctctataatccaaaggcagaaaagagcattcattgcctgacccatgttctcttccatgtgactagcacataatggctgtacctcggctcttgtggaaatttagagtgtggaagccgtagaaggagcagttccaggaatagtgtgtgtgtgcctttgtttttggcagatccatcttgatactaccaacacccagtttgttctaaatctatggaataattctggagagaatgaaaatacccctatttactgagcaccatttagtggaaactaatggtaactactacacagtaaatgccatgtgctgagcaagtcacgttacctgatagctacctgaccttcacaaaagccctgggaaagtgggaattaacttgctcccagttaataagcaagaaaagtgaagctcagagatatcaggcaacttcccagagtctcacagagtcagtggttggaagaactagcatggagcttgtgaatttcccattagaaagcaaaaattccttagatttaaaccagaaaactatttagtctcatttaaatatcacttcatactattcaccttgaagatgattgctttaaatatttgaacaaattatggctaaatgtactaaacttgagactaacttccagtatagcatttctaaaccaaatatgatgtcagaattgcaaggaccagttaaggtcattgtagaaataaactagatcctccttttttctttttcatttccctgaaatagtcttcacccattgttatctatttgatctcagccatctggttctgcagccagagaaggaaaatgtcaaattcaacaaaatgagtagtactgcttgagatgaatcataatttaactttttttttgctctacaagatatttaaacagtaacattgcttaataatacttcctaagttattatcaattccctacaaacgttgccatttcatccaaatggaaaggcaagcattaggactatgagtcaaacactctaccctaatatctaatgacatataaatttgagagttaacatttactttaattgctgaagcagtcatgctaagtgcatcatctgacatattaccaggtgttaaaaagggtaatttctgaggggaaaaaagtctctaaaaccaagagacagtattccactaaaagcgttgttcatctcttttaaaaaatcttcagttaaatagattgcctcagtagtttgggaaatggtccctgacatggaaacatatttctgtaatctttgaagggaaggggagtgctggttattctctgtgtttcctcccaacacatagccattctctatccatctctcctgaccccatgagctgcatctgtcaggttcctttgccccctggtttccacctgggttttgctaatggaaggcatcagctgcaagagatcaaagggcagagggagagagagcaggcagagggagagccagcgagcagtcctcaccgttcccttttcaccttgggatgcagctggttctggcaggcagcccctcctctcagctcttgctaactgctcctaacactggtttctcccctaagacctacagacaaggggagaaaacagttccctactgttattatgctctggtgtcttcctcacttgttgatccctcaacttacctactccctttgttaaaacctcttcaattgaatcatttcagtggaattccattgcttgacaggactctgaggagatgggggaaaagtcactaaaatacctgtgtcctaattctggcactactaaactgtatggtctgaaacgatctacacaattcctcgagcttcacttttatcttctataaagtgagaataataatgatacccacttcacaaagcactgagccccgtgagtacaataaggtgcaccaggaattgttactattagtttgaataaagaaaggagactgcttgctttcctgtttgagttagtgtaagtgtaatccactatatggcctccttgaaattttgtctattggtaattaactactaatatgtatttctaaactttgggatagaatgatagaaatgagctgatagttttaaaagagatggtttgattccattttttacaactcatacatttcttgaacctccaaaacttatattttctttctccctaatggcttactctgtgttatcttagaaaagtttgttggtagatactgggggcaaattaggtaagtccacttcacatataaaagatgtattctccgggttcctagtaatgacacaatagcagcagaagtggcacaattgggggaagaaaatggctttttctcccaattatgaagtacttgtggactattaccaacaaaacagaacacaattcctcagtgtgagcattcaggaagcaaaaatatttattgcagtctagtctgccacatttggaggaagcaccgtggcatgtatgttggggaagttagttaccaaaaactgggattttgtccctgatttatgagaaattctgtgtgtgatcctgaacaagaagctgtcttactcctctaaacctcagctgcagcacccagagtttcttgtgccaggatatcaccacatccattgtgcatactcaagataaatgaatgtaggcttagtgagggtcaaaaaaaaaaagtggggggcaggtggtggttagaaaagcaagtaataccacctcaaggaggagtaggtgagatccagtctcttgtttgcttttcttttaggtaaactgttaaagcatattcataaaggagcaaactcacatttacaacctaaaaaacatcaggctataagaatctcatcttgttttccaaatgccttgccaagtttgagaatgccaaacagaatctgtttcagatgcctttttccctcccttttctcactcctccttttagtccctttccatattccctcctcctttccctttctggacctgtcattgccccatgccaaaatcaagaagtagaatttaaaaactgtgctgttagaaggaacctctttcacatccccttgcccagaggcaaaggggataagagaaagtagttactgtctgtccagatttttttacactattgtgataatgataaatcattccccctctgcactggcaaggctttggactctgtgttctgtatacgttgcctcttcatcattttcttcaagtttttatttgctagctttttttctacctatgtgccattgcaagatacttatggagtggctggaataggacagtttctttatcagcatcatcaatgaatgttcttgaggcactgcatgtgaaatacagggctaagcaaacatgtttaagatatgcttcttttcctagaggattgcaatctacctaagaagcaggagctaaataagtaataaaatgcaattcaaagtcataaaagtggggagtgcaaagaatgaggaatgggcagttgcatatattggttattgccagaggctgaaccactggtgtatgtcctacaagagagatattagcctatcctgacaccttttgatgaaaatattgtgcccattttacagataagaacaatgaactaagagagtagagatggcctcccccgcagtgtaatttgccagatcccactacttactctgtgagggaaaaaaaataatgagtgggctaaacaataggaattcaaggtaatgtgtttgaaagccaaggcccaacagagattctcgaagtgtggtacccagacaagaagcatcagcatcacctgggaacctgtcagaaatgcatatgtttgagccgcaaccgaaacctgctcaatcagaatctaagcgtctgggcattaaggcttagcaattcgtattttaatagggccccagaggttatctggaggcaggctaaagttgagaatcattgacccaggaacaacgtatttcagctggatggggaagcaggcaatcagagacagaggcgagatggtgaggctgggttgagtggcaagcagtgataatccaaagctctgagatggcagcctgcagacctggctgggtgtgaatgggcctactatagcacccctcagtgagtagcctggtgtcctgctgaggataaaatgtgaggactgttcccagctttcttagaccacgtggtcctgctatgtcattactctgaagacagggatccctctgcctgagaatttagatagctggttgtcccttgtgagggagctcctctgcagcctcaagggaacttcaagaaaagaggtttatgaccacttaaaaatactcatggcttcatttggatgcttataaagcacttttaatcatgatgaaatgcaagtattgcctttgaatgccttgagttgaagggaaaagttaacgagtgaatgatttgaatcatttctcttcttagcctggagcaagccattaaaagaatgaaacttctagtcaagatggaaacagcctgccccaaagggatgattgaaagagtcttcaggacaggcatttgtcctttagttttattttcactttaattattataaaatctgatttaagtgttgaccatagcctccagttccagccagctgaaaagataagcacatttgtatttgtgtggacaagtctgcagacttcttattgttgtctcaagccagacaatacaacccttttaaataacagttcctcataaggtgagattaaagatatttcttcttgctgttaccaaggaaaatcatgatctagttgattatgtacatgaaaagaaagtatctcttggctattgcttggggttgtgacatcatctggtgtccactatctttactttgggtaaatcattgctgtaatattgatgaaattacaaaataatggagaatcagaggtcatgttccccaactctaactataatgaaaactttaaaaatgtttagtcccaaattctccttggaaaacattggttacaggtaaaatacataaatttatatcaaacttagttgtgttgttgttgttttcaatgagctatacattagataacctagaactaatcaattgctgttgagctgtaatgaaatgtaaacaagtggaccttgtattttttatggcattctgaaatttaaatctaactgattgtagctaactgaaccttaaggaaaaatcagaggaaacttgatcctgaaaacattagcacttagcattttgtacgtacatatgctcaaatatgtatccatggtatggcaaaaaaatatcttactgaagcctgtttcagtttcttcatggaaatttcagttgattgtccattttagtaaataatatagagcatgttattcctatcaaccgatcctgtcaattaatttagtttgcagtggagagtttgtgggaccatggacttctccttgatctttaaccaagtcttccctgggttattgcaattccatgtggatcaaacaacactaatcatgttcataaaataaataagcacatatttccttcaggttcttctcagaagttatcttgggtagcttctgttgtcttcccagaatgatgtgacagcatttggttgtaactcctaataagctctctgacctgtcttgtatcctcaagaggaaaaaccccaggacactttgctgctggatcaaataaagtaaatagtagtagtaggtgacatggagagctactagatgattcagagggaaagttaaactctctgtcacccaaatcccagccttcttggttgtatgcaaccgttgatgttgaatgtgctatgaattatgacaggtttatagattttcttactctttcccaggtttttcattattttaatctctccttttaaaatatactaattcttacatttataccatgttaaaacagcaagaaaaacaaaactataaaatcccatcaaccctatgcctccctctggctctctgctcctttctctgcccagcatggtgcttcactgccaggcttctcaagcttctcaaaggaattctttttcttcctgtctggctgatgtacccatcactagccttgcttttattgaggtcaccggtttgtttgtttttttaacctagggtctgctgtcttttcttccttggcagttctgcaactgtggtcattgtcacatttttctttcttgaaacactcccctacttcttacttgataccattctcttctggttcttctcattttcctactactcctcattccccatccaggttttattttctcagcccagtatttgaatatgattgtgccttacaactccattttgatagtcttctcaattggtacccactcataaatatattgtctttagagcaactatgtcctgataacttccaaatttatgcctttaagacaggctgtttgtctgagccccaaaccccagactttttgctcatgtgtttaccgatcatctctatatacttgttctttctgtatttatagctaaggcactgcattccacttccttacccaaacttgaacctggaatttattcttgtgttttttttttaatttctttcaccccctccttgccgctcatagatgccagtttctgacagttcacatcctacatctatctctctctctgatgtgtctcttttctctgttgctgccacccttttcttaacttcatgtcttcatcatctctgccctggattattgcttttgctttccagtagactttctacttccagttatacaaccccacattgtctcatggagaagttttatgaaatggctgttgatcatttcattgctctgcttataaaccttatattgcaccttaagtctttcagcattaaattccagttttatagcacgcttttcaagactctaggatttgagcctagctccatttctatcctctacttcctctgcctgtttctaacctattgctatgcctgtatatttacaattctcgaatgcatttttttgtatctttgccctttgcacatgctgatccttatgtttatgcctcttttattctgattatttccacattgccctaccccattagcaaatatctgctcatctaatactaggttcaatatgacctcctggaagctttccactgcatgcttctcatatccctacacacaatagaagtaagtactctttcttcagtgattctagagttggagacaggtgcctatccaagtgtactgcaagattctgtttatggcctgtctccaccatttgtgtaagctctgtaaatggcttttatggtcatttttataccaagtggcaagaagaaatagtcaataacattgtggaaaaaagaatcaaagcaacaaaaatgtacatgaactgaaaatatgattgcttgacattgaatattaggtcattagcatgccagagctatctcatgctggctcacaagagccaaatgtttaaaaaccaggaatcttgccagctagttgttaagccctttgaggcttgaaagtaggcatggtgggaatatttacactagggaaatcagcaaacaccacaaatcagcgcttttgtttttcagagagacagttttccagcagactactgatattcatgattacagtgcagtcagttaattcatgctatgtccatcaaccatgtgatagcaccagaaatcatagactcatgttctgaaagttcatatcctaaataactctctgtgcctcttctttccattcctataccaccttgccttagttcctgtcttcgttgtctttgccctagaaaactactgttgcctcccagtagatggtaccaccagaacaatattattgttaaacctaccactagaacaatctttgagcaagagtcctgccagtctggaatcgaagaagttagttatcgttgactccttgggaataataatgtataatgctttattatataaagagggcacttttaatttatcatcagttgcttatgaaataatttctttttttttttcagttgcagtgacaggtggatttctacagactgaatctgtggccatagtacttatttcaagataattggccaaggctaggttacatcctgtagccatgcaacagtgacagtaatttgatcacaataatgctgaccccatgacttttgacttcataattatcttgctgtagtcagctggccaacagcacttcatcaatgaaaatatccaccaggaggaatattatcatggggacagttattagagccacctccattttgactttgccccaagcttggtctggggaaaaagcttcttaaagttgcctcagcagtagtttgctgcctcccagcctggttttaagtatatccataattaacacgacgggtagaggtgcaagaatgccacattttcttctaagccatgcaacctcattaagaaagtaaaacgtttgtgagtctttcatgcggtctttctccctctgggttgttgaagctctctggatgtcagcacagcactatgggccaggaaagttcagagaattacttcaataatatgacagcctcttccatttaaaatggaattcaatgctggcttcccttggaggcattcattgaaattccgtgcatgatccattcctctagtcatttaacaatgtgtctcatgtttgccctgatttaaagaaagaaagaaagaaagaaagaaagaaaaccagctttgtatttgtgataacatggatcaggatagtataattgcagtgaagaggcccctgagcctgcagtaataggatggttcatctgatgtgtactgccattagaaaatgacccatgcatgaatgttctcaggggacagtaaagaggcttttaagaattacattctgtgtagtatgaaagctaatgagcaaaagaggaagtacgaagaaaaactactgcttcaggaagcatggttccacttaggtagggcctgtcacagctcccctcaaattcatttggatagacaggccattactaggatgactactatattacccccatgcccatgcacactccctgcaggtcatcctgtaccaagttcctaaggaattaaaaccagcgagtaataaatggtgaggaaaagaaagaggatggatacagcaactgccaataaataagttaaaaaaagacatttacgtcaaagatgaaagaagtcgtaatgaacttcaacagcaaaaaagaaagttaaagggaaaaaagcaatttctggtacatcctctttccacgttatgctattttacttcatatataagaacagaacagtacctaattatgatttcaagtatatatattttaaccgtatcttaatttgtaaacatgtttaaaaataatgtctccagtctagtctatactgctttcttgttttaaaggttttacttggccgggcgtggtggttcacgcctgtaatcccggcactttgggaggccaagacaggcagatcatgaggtcaagagatcgagaccatcctggccaacatggtgaaactccatctctactaaaaatacaaaaattagctgggtgtggtggtgcgtgcctgttttcccagctacttaggaggctgaggcaggaggaggagaatcatttgaacccaggaggcaggggttgcagtgaactgagattgcaccactgcactccagcctgacgacggagtgagatttcatctcaaaaaaaaaaaaaaaagttctacttagggttttagattacataaattgggaggttggcatataggcaaaagaaagagtcacaccttgtttatcaaagttaacaaactttgacaaaccaagtggtttgtcaaaccacgtttacattgtcattccttggatttatctcctgggagttgaattagagtaagatagaggctataaaggccagtaaaatcgatgccttccttgtgcccgaggacccctggttctgataggcttcattgtgagtgaaactgtggaggctgtcttctgctttacgtgagggagaagttggaggcaggaacatccatgaccccaaaattcacctctctgaggcataaggcagtgactcctctttcaccaaaccatagtgatactaaaatatcaagctgtgtgtctgttttctccacctaaggctactgtgaacaccacagtgctatcaatagatgaagctagaaaatatttctgtcttaaaggtgatgtgccccagtaatgaagtgagacaggaaaaaaatccatagtgttcacagaattagaaagcagactgacagtagtctatgaattccaaaattagaagtggcctgagaggtctttatttctccaggccttcatctgatgtcccaggttgtttggcagagtccctgtgtatcttctttttttataacctaattttatctttcaaataatataaatgctattcttgtttctaaaggccaagttactttcccagaggcagccagtagcctggaacagtcaaatcattgaattgatcttatatttaagcagaattaagctatttgcacatttcaagattttaagattatttcgagaaaacaaaccagaataaatatagtctcttcaaagattgtgaggaaagccattatttgaaatggtcctagtaattaaaagctatagtatcactgattagaaatgaagtaaatgaagggacaagagtctgtttgaatagcctcacccatacctcacccctcaactgtcttcctggtgtttcgctctctaagtaacatgtcttcaaactgttaatgagtgatatgagttgattctgataggcagtcatgttttacatttaatttctcttgtttttctttatttgatattaataaagtcttgttcagcaaactgtggagcataattcttatcttttttacttaattgttttaaatattgagaaaacaattaacataataagcagtcattgaatacttgccacataaaagggatgatgtgagggctatgagaactagaagaatgtataaataaatggtactacaatttagcacagaaaagcaaggatgccaaagtcagaaaaccacaatttaaattttagctacaattcctcgtaatagctctgtgaccttgacaagttactatatcctcctaagtcacagttttctcttctgcaaatggagtttagtaatattgactgcctcctaagattgtcataacaagagcttaattcactgtttggcttagagtaagtgatcaacaaatatagctagtttataatggaaaatcctcaaagaagataaagtacagaagaattgacagggagccaagaaaacagaaccaggcagatactgtaaagtggcaaaatgcaaaaattgtaaaactgcagctaaagacagggcttttctggataagcaattttcttcttcatattcttcaccagctatactattaagctaagctactgtaattctacctcacaccgtgtacaaagagcagagtttgattcagaatcagggctcttgctggttcctttgaaatttggagaaatattcgtatcttgtcttcaagagaagtaatttttatatgaagcagcttgctaactctaatcatttgaaaagacattctaccatattaagattacttcccttaatagacacatgtatatcacactgcttgggtggactgggagaggctgtgagaattggccagcttctgaagaaatgtgcttggtatagaaatttgctgtcttcagtataccgccttccctgtttcaacctccataattaacagcaggcatactagaaatgcagaaatagagattactattttgtctgtcatttcattcatttccaaaatattgaaactgtaacaaactactcaaataagagttaaaataatatcagtcacaaccatgccaatctacaatccctaatcaatttacattctaattgttcataattgtgctacatgaagataaatgttttcttgactgaatattaaccaaatgccctcaaactacaaatagtatgcaactgttgtattttagtagaaaacctattccattttcagattgatacaatgcagacattttaaatcttataaactcctcgatctttgccaagtgcgttcttttatttgctaggaggcatttgtccattcctaacctttttacctccagaaaataaatgacacatgtgacttgaaaattgaatcgatcttgactgaaaaagaaataataaaaatagctaatgtctttatcatctctgtagcaagcctacagggcagatactgttgctgcttcagttttgcaagatgcattatatcttgctaatcctcaataaatatgaaaaagtgataatttcacagctaagaattgacaaactggaacacatttctcatttgaatagacaagataagcagttctcaccagtgctgccatctctgccttcgggtgtgttgtgtcccaggcaggcactgtcggttcattcataggtcactgctattttatttctgtttgtctatttctggaccagaactcagattcacatccagacagctgcctgtcttaaagaccattctgctctaccttctgtgacataatttaaagaaatgagtagccccaattaaaccattgcaggtgtaaatttcttgcctggagagagaattgagaaatgaatgggattcatgaatataaattgggctctccttacactaaagttttcattttgaaatggtagagtattcactccccacataaatctgtatttgccttaagtgtgtttaccatgggaaccccagtgtaaagctcgtagcccattgctatgcataactgaatattaaagttcacaaatcattaggcagaggaggcctggagaaggagatgctgtggcagggcagctgcatctgggctggcagcaaagacgaattctgctctcacaggctctgcacctttactaggatggggccacccaacctgcccactctttttctcttcttaaatattatttaatattaaggattgcttcttcttccaaccaagacattctgctttctgaatgtcttaacagctctattattttcccttcacccaattttggtttagaagatggtgtgttaagtgaatctcttataggccacctaatttattttcaaacaaatgcctctgtgaaaggatggaaggattcaataaggaaatacgtaaataatcttcagacgctaagcaacccgcttctctttcccccacttccctcttttccttccctcctttcctctccatcttttttgttgttgtttgtttacattgtaactgtatatattctgtgaagatccattgaggccaattggcctttcagtgtataaacaaatataatccaaagtactaaatggcactcctctcattttcaacttgtgctttcaatcttcagccagaagtaaggccttattatattcacaattatatggacttgagaatgagtgtacattgcctgctctttgctgtagaactaaatcagaaggaaatctgttggttataagttttctatgatcatcccaagttattttcttatgtatataataattcatgctacaaagagcttggtgtggtttggaacaatgtcataataaaatggtaaaatagccacagaatttttcagggcaattggatgtatgaatcacaatgggagacctagacaatgaaaaacaatcggaaacaattttctgcaattaatgtgaaaataattttctctcaagtctctctgcaaatgagaacagagaagtagaagtagtgaaaatggtaatatgggattaatcacatttcttgttcccaggtctgatggtttttccttattgtataaacttcaaacactgtaggtatgcagaactctgagctgatcttgttattcttaaatagacctgccaagcatattaaaggaaggttctgactgtctgctgtggacagaatgtagctcaaggaaatgtggttattacccttaattatattcgtaatatgtggtgtctttacaataatttaaaataattcagtaaattgaaaccactatgaagataatttagggtaataagaatgtaaaacaatgggacacataaggaaggtcaaagggtagctttttagattacacactggttccacttgccaattgtaggcatagggcagacctctcaaattggccttttcccaagcttgctctccaattctccaaactgaggacaccttgcttctatctcatttgatgaactgagccaatctcctaattcagtgactatttgcaagccaaattttcataatatttctgaaatgaatgaagatacattttgtatatccaaggatagttaagtattttcttttataaagactataatataatgtggtccttctttaatataaagactctcagaggcactcaatatatagattacttatgaatgatgcatgttgattagctagtttttaacttttggtttcaatttttaaaatccgattgtgaaagttagttcatatttgtgttaagaaaatctaggattttaaagattcttttctctcagagaattgtattaagatagcagttccacttactcttaggtgctctacatggttaataatatgagctctggaaggagcttattatacagcataaaatgaatgtctttcatttctctaccactgtgtcattttcacctaaatcataactttcttcccaacatttataagaacaatcgacaggcttcctttataaggatgcattttaaaccactcattgaagtgaggatttaaataactagaataaatcaattctggcctacctaaaaaaataaaaaaagacaaatgaaggctaacaaactgacccacccagaaagacatgaacagataaatttttgaatattgtattctttattatctattatatgtattaatacttggtcacatattggagtattttaccaaaaaattctctcagaagctagtggtgaaacagaagaaaagcatcacatgcgtcccacttgctgttgcctttttgtctaaggcagtggttatcgtgaattcctcagggtagcaagtcatttggttcactaggacataaaaaaatagaatttatccaaagttaatgggctgtttggtggtctctatgtgtgaaatgagattgtccaggagaagaggatagtcagggaatgagtcaatttaattttaaaataacttgataatctgtgaattctccaaatatcctcaaaaccaaagaaaaagccaaatatgaaaggtgtaatttatagtagtcaattggtatcaatagagtcttctgtttttgtgccatgaataatttatcattgtcacatgtattcaatagaccattctgcataacaatagaaatgtcagtgaatttttaaagccataatcttgttcactcttagaagtaaaaaaaagagaaaatgcattcttagggaataaacatctgataacacattctgaatgtggagactgagatgtctgaaggctgccttttgaaccagtagttttaccccatgaaacatcactgtgttctttctgcacaaccagttcaaaagatctcttttcttcgcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgctcataagcagcttggaaaattgtgggttttaaagtagaatttgccaaagtggaagctgtgggtctgtccctggtttgggtggctggctgggtaatgcgtgcttggtccataactgttgataatttactttgaatcaagattataatagaaaagtagaaaatgcaaaatacatgcttctgtcactactgtggcttttgaatgctctcctaagtttatttccatataacttcatattcatggaagaaaatacattagtctacagttttattcataaagacctttggaaattttattgcattttgcttattggtagaaagtcctcatgacaaattcccattcatttttgtacacacccaaataaacttcatttttccataactttaagttataagagattttaatatggcatctcagattcatttaaagggcatttctggagcctagcaactacattctctggactaaacccaagttaagtattttaaaagtgttatgtatccttttgtgatgtatattctaaaataccccagaagtagaaataaagagttagtgaaatggtataataattaaatttaactgtaccaggtgcttctgaccctaaaggacctattctagggcccctaccctactattctgattcacattgcatcaacttctacctccacctccacaataagtgttctctaaagttgcaggttgagaatatagtaggtgcccaggacaaaagcccttttcactgtggaggactccaggccactttgcataaaatcagaaagggaacatggcttttcaaactgagagaaacccagagtggaagatctagactatagtttctagaggtcattgagagagaagggaaggaaactcagaactaacaccttctcagcatctactgcattccaggcagtgtgccaggcactgtacaccatcccttcaatcctttcaatggtactttgaagcatgtatgtcattatcgcaatggactagggaattagagaggttaagtgactttcctaatgtgaaacagccgataaatggcagagctggaattgatgacctgttaggtctaactcaaaagtttgaatatttttcatgacaccatgttgtttattgtacagaccaaaatagtctcttcatacagggttcttgcttgtgtctttttacaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacct

SEQ ID NO: 41 - DNA, 51717 bp, Homo sapiens
agggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtgagtcgctggccgcgccccgcctggctttaccgggccggccactgcaactttccctgttctggccccgccccagccagggagggctgaggaccaaggtgtgaggcggcgctgcccccgcatccgcccgaccctgcgctcgtcccgggctcctctcgccgctccagccgccgttgcctggcgacggagccccggggcccgctctccttcgcgcatcggggtccccagcggcgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcggctgccttggaaagaagcgtgatgtttccttttaaagcccagacagccctgtcagaaatcaaattcagaaatcccaaggccattcaccttacaggacctaggccctgtcaagttggctttagaaaatattttttgatgccattcctctttcctttttttttttaagaaatactttaacaggccttttggattacgagatttctaaccagagctacctttgggcaattcagctgtgaacttgaggcagatgggggtgggttggggagacagggaagtggtaatgaggaggaagattcttttccgggcattgtccttgttaacaggaacttcaggaacaaagacaatcctgtaatggctccaaaaaaattcggccaaaactttagttagcgcctaactgttaaggccttgctggacacgctcactgatgtctggagaacaaggtcagagtgtgttgaggttaacagtggggagttcttgtgtctcgttctgtgcttacattatcccatggctctgtgaggcggacccatcacctgggcaggaagagctttgaggtcacacctgattgtccttggccatggctcatccacgaggaccgtcagaggctttagctccactgccggatttttctccaatggaacatctgtggctaagtaggtggttgagtttcagcgaatccctgaagctcagcctggagggtgactcagtgcaggaggcaaatggtgcccaccagctctgattggagtgagtttgtttggcctgagtcacacacagagtcgtgtgtcagctgtttgtgagttgattggagttctttagcaggactcgtgagcaggaatggcctgagcccaagtgttttgggcagaggtgggcaagtcctctgaaggagctaagcagagctctggctgttgagcaagggtcctggagctctgactccttgggaaggtgagcagggccaggctgggctgggcagggagatggggagaggtgaaggggagggtaaggaaaggctctgtgattgtggtcagaactgggcccagtgttctgccatgtgccagtggggtgaccttgggcaagtcaattcacctcgggagtctcagagtttcctcagttgtaaaacagggatgcctatgatattatttctgcaggcttattttgagccaggtgctagacacagcaggtgctcattagatgttagttccccatcccttcccttatgggccttaaccagaggcaattctttctctcattgcttctgctccatcatgaaaggggttgtggggacacatgaaggttcggtgcttcccatgtgattaagaaggacctgtaactcagcttcacatagacctgtttccaaccctcaagtctccccatgagaccctaaattgggaagcctgcttaagagcaggattagtgttggggtaggggtggggttcagctgtgctgggtctgctggctgcccttggccacctgcaacagctctggggtgactccagcaccacagaccttgactccttggggttgtttctgactgtagcctggtcccaagctgcagcacgtgctgggtggacttcaggggtcacttctctttgttcaggtcttaccatcctcctccccacccattctatccataatagaattgaaagttacaagagaactgttcaggagagctgagactggcctctcctggaaaggaaagtgaggtgtgtgattcctgttttcctgaaggaccctgggcccctagttttctccgtctataaaatgtccagatttggtgctgagctaagatgtgtgtgccttaagagtgaaggaaataaggggatccccagtgcagcaagaaagaagccatgctggctcaggggactccaatctgctactggaaatgtgtgtgtgtgtgtgtgtgtgtgtgtgtgtgcattgcattcaccattcattctgtagccaatgccctccccattggatccaggagcaaattccaaggatggcagaaacagagatgagaagattccagagaaacaggttccttctgcctgtgtaccctcccttcctttatactccttttctgtccaggtttgctgcagcaggacaattcatcattaatccctttaaagctgctaagataagcagcagaatagtttaaggggaagatggatttaagcttttttgctagaactagctctgagttatcacttgctcccaggctgagctacaagaagtcctcacagccaaacatctggagcaccaggatgggggaaaaaaaacctgtcacctcagcccctgtgtttccctcccctgaatgatgttgctggctgccagaggtcagaagcacagagccataggtagatgtgattgctagagcagtatcccaaactcaagtggggcagtgatatgtaaggaaatgcctactttgcatgcttttaggaggggtgagtgctgttctggattccagtggctcacactgtgcttggcacaaattgataatatccagttgcttattgaggcttctgtgctgtgctaagtgctttattcccagaccatctcatttaatcttcaccacaatcccaggagacagatattgctatctccagtttacagattgtaaaatttaaggttcagagaggttaaataatttgttcaaggtcacacaggtgagtggcaactagagaattggaactctatcagtccaaacttcatgttcctaacctctatgtgatacttttccgcaatacattcttaataaatgctgacaacctaggcatttacccaaacaagattgtctagagctgtgggtccagtttttttaagttagtgccccgggaaaaggggaaatcggcctgtactaattggaaattggtggaaaacaaacataaccaaacgtccaaggtttggggaacatggtatttggctccaggtgggttgaaatacagaaaaagatcccaggcttcatcttggtgctttcttgtcctttccctgcccttctcttcctgacctctactgcccttgacctcattcccttaaaatctgtctaagctaggggttcgtgtgtagagcagtgagaggagtcagagccggtggatgttgccctgagaatttctgcatatgcagaatcaaggacggccacttgctgatgggagcttggtgggtcagatttctctgctgaagagtgtatgccagggatttgtagcagtttctggtgaggccccagaccccagagaaaactactaacacttcaaggttatttacagcagctgctggcagggctgcttggggagattccacttgcttcttcctggtcttttcccacagagagcccactttctcctcactccaaaactctgccacacgtgtccgtggccgttctgggaaacatggcacctgattcctccagcttctctgtctcttctctttctctgaaaaatcgccatccccagaacaggcccatgctgtcctagcctgcccatcatctccaaaccacctgagatctcagtggggaagttcctgaaggtggataactgaatgtaagtattaatgctcctcactggcagtggacgaaaaggacttcccagaaacccttgcttcataggcagccattttgtggagataagtcctttgataattctctttctcttccttctcctcctcccatgagtgattcttaaaacattgctcatttatgggcaaatccagttttttttaaaaaatacatagttagacgttcaatatgtacagaaaattcacatgtaagaacataagctcagatgcaatatgaattactgtatacacttactctcatgttcagaaccaggtatgttttgttagagaataattctgggtcaggtgagttctaggctgcctgagtccctaactagggagttgaggcacaaagccctgtccagtctatgtcctcttgtggagtgggagtgaggcacatatagagcagaggagtgagtaccccagctcacaggccctggggtcacctcattagctgcagttgtcccactgagctgccactctgccttcccgagcctacctagcagtttatttgaagataacaagttgcctgtcactgtacgccatcatttctaattagtggttcaattagaatttctgctggattctgcatcccaccaatttaccaccttctattttgcttgcaagtggaattcactggtccacaccccaaaattctgccagttacatttttctttaattataagactcctgggttcctgaggctttaaatcccacaccagctctaaatggagcagaagcaatgtttgctaaaactaccttgcaagaggaatgaatagtcactcgatagggtggttccagaatgtactgccaagtgagtattcattgaggacatgggtctcccttcctttgcccaggtctaaaggaaggagagcagatgttctgtactgcgcaacctggggctggctcgcagaatagcccggtgggcgctgtccatggtcctgccacaccactggggccatctgcctgctagtaatttgggactccacataacagctgaaaggaatctccttgaccagttccccaaattgctttatattgtgagttttggaagagaacttggtcaagtgaggaagatcctgctctctgggagaaatggtggtagatgagctcagtccactgttgacttcctgaatgtatcattttgcaaggctgcatggtgcactgcagaacttcccaaccagtgccacagatgggtagcatgtggcccagaaataatgatgccctcatcccttggagtagcctgggatggcctagcatggtggcgcctcctccgtgtaccccagtgtgccatgatagtgttattttctgtgtcatgacatgcaaaagattggaacataccagtatgtcaaaaagaatatagctacagtttggtagatgacagtctgaatccccgctcttccattttatggctgggtaatcttgtacatgatagaggcttctttgtcttgaagataagaattgtattttatcgtaagttgttgggaggataaataacacatgtaagcacagtgggtcacctgtggcttgtcccaataggatgcttttctgcccagccctctacaaagctgcactggaggctgatgagaaaagagacacaaacccttctcattttcaggaaagagacatcatgttgggactgtaattaagggtttctgatcactattccttcaagagctcttcagcagtccgtttggtaactcaggtaattgaacacccttggttccctctgtctctttctaagacaacagaaaatagtggttttaagaaaatccaggtcagattattttggcagatgctgtgaggactcatctgtccccatggtggtccccccatgaatgaggaaagaagggaatgaggctttcactagttattcctggacttttatttgcacatctggtttgtaaaatttttctttttccaaattggtatactctcacaggtcctttatctgtctgagacctggtgtgcccttcagcacctcacgtcctcatttccctttctcttcaaatctcaagtctcatccaacagcctgatccatatcaccatcatcgcttacctaccctccctgtttcttcacttgtcctaccagcagccattgatccctataaaaacagtcaggtcaggccaggtgtggtggctgacacctgtaatcccagcattttgggaggccgagggaggtaaatcacgaggtcaggagatccagaccatccttgccaacatggtgaaaccctgtctctactaaaaatacaaaaattagccgggtgtgctggcatgcgcctgtaatcccagctactcaggaggctgaggcaggagaatctcttgaacccgggaggtggaggttgcagtgagccgagattgcgccactgcactccagcctgggcgacaaagcaagactccatctcaaaaaaataaataaataaaaataaaataaaataaaaataaaaatagtcaggtcacattactcctctgcttgaaaacctccaacagcttcccattagccttgaaagaaaaccccaactcctttccatgctccttgagtcctgcctgttctggacactcactgtcttcctagcccagcacctcccactcttccattgttcagggtgctctaggcacatggccgtctgtctgttccttgtactcaccaggcatgcaggtcctgcctcaggacatttgcactttctgttccctctgctctgaatgctttcccaggacatccacatggcccactctctcactccgttgaagtctttatgtcaccttatcggagcatacgtccttacccccatctctgttgtagcatccctgctgtgctccatcccctcatactctatattgtatgtgtttatttgatatatatactatcagatatagtgtatgtttatatgtacactataaattatatatttgtctgatttctatttgtccctctgcactagaaataaatccaatggagcagggacattatttgctctgttctctgttgtactagaacagggcctagaacataatgttcagcaaatatttgttgaaagaagtaaaggaaaagaaggagggaaagagatttaaaaatattttaaatgccatattttaaaatcccatatttcagcagtacctctagttcatagaagtcgctgggctctattctccttccaggccaaaaggggagtagaagtcggagaactgagccccagtatcccctgtcagcccactgtgtccttgggcttgcacgtgcatgtcccacccagctccagggcgttgtgggatgtgggtgagtatgccttgattcctggctaagcccatttcccacatgttctcacatgaaggtggtagctggcactggttgatggcatgcccctgagggcctggcctgagttgagcataactcttttgttacctcattttatactcatgacaaccctacgaggtgtagcatccttcatccctatcttttcaggtctagaaggtaaaaccaagaggggttatgtactttcccaaagaccaacatctcataaatggcagagcaggactttaggttttcctggctctaaaacccatgatagcattgaggttgagagtcaggctccagggtcagtctgtcagtgcagatccaggggctttggatgacttgccttatttcatcaattccaaaatgtgtatttttgcacattgccacatcttaaaatcaggacatgacatgcaatcaatagctgtttcaaaatggctgtgggtctatggcagctcaccctagttgggtgggaaactttgatgaaccctttctggtaagttcaagaaagtgccagcatcaaaggatcctagattcaatgaaatataggtaattatccctctcagcttccatgtcttcatttgtaaaatgggagtaacagtggtatctacctgatataattactggcgggattaaaggagctaatatctgtttggtgctcagcatggtggttgccacagagatgggactcaagaattatggcctatgtgctgtgttgtcattgttattattactacaccccactctgccttcagaagttcccccagtggatccctcagcacctgaattctagtaaagagagaatgcatgggttgggggggtgctttctggggctgcccttgtttacatgcacacagagcatgcgttctcccacgtgagatggtaaaatggaaccacaagatctgtttgcactggccacacccacatttttcagtgccagttcctccccctctggaccatctgccccctttcctgcttcccttccttcttgacaaagaaaacaagatattgactcaagagaacagactcagcaaatgcaacaggaaagtaagaaagggctgcagaagttgccactggctcctcagctggatttcttgtttggaatggtcccacaagtcccaagccatgctgtgtgtcaggactgtgcccacccaaagatgatttccctgaggtgaggatggattctgtctacaaagtagggaaggtacagcacaaatactggctcttttgaaagtggccaaaagtcacaaagggatggccaggcttcttagtgtatcctggctttcaaactgtcacttggggcatccttggggcatgatatggtcttggcatcagaatattgcatcagaaaatggaaaaaactagaagttggaaaaacacatcggactccaggaactttggggtgttcaaaaatggatcaattcatttatgcactcattcaattccatcatatcatatttatcatgctcatattatgataagataccaggatttggccttgcagaagcaaagatggtgtcaattgaggtatgaaatggaagaccaaaacacaaacccgacaaatctgtgaaatggaataaaaagaaatcaccactctgttcatttgatttttcaataagcttttctttctctttctccttccatccatgtggtaaccagatgcagctggtaggtaagcaggcaagcactgctcctcattttacagatgaataagaaacaaactggcttccaagtcttggggctctccccatgtgtgctgcagggctgcactggattagagtccccctggctgggacatgcagacttccggtaggttcaaatgtctctctagtcactgctgttagtgttttaccccgcctctttgtttcaaatgtgaggcagtagtaagatttcaacatggcaagcaggttgttctcagagggttggaaggcagggaccctagaacacctgtaaataccatgttctgcccacagaaatgtgtaggataatctgtgtgtgcgaagcactggttgggtaggaagcagtgaagggtgggcacaaagctgaatgcaccttcgctcctgcctcaaggagattgctgttcagaaaagggatcaggcgtaacgacaactagttgtaccagacagccaaatagtaaaatagtgtaaaagggtgttacaaggagtgtgctgagaagggcagagcgttaatgctcactcacagactcgcaggagttgtcatagaggcgaggcaggggacctagaaggcttcagctgtcaggggatgggaagtggttagtctagagtgagtggtgagtgggctgggaggaagtggaagccgaggcccgggagatagagggggcccaaatgcctgggaaagggccttgggctcccttcagtaggcagtgggagtggggtggcgtggcatttctagaagatgccactgaaggcaatgtgtaggatgccagcggggaaagtgagctgggagcctgctgtaggcatctagccagagagcaggcttgaactagagcagaggggtgggaagaggacagagctgagcacgcctacaggacttgcaacacctggtgggggtggaggcaagagaggtcaagaagggtgtggggtccctgcctgtgtcctgggccagcagcatccaggggcagcagcctccaagtcaaggccaggccctgtcaggagcagtttgccccaggtgactgtcagaggttttaataaaacaattaaaaataatttgtgtctctgataatagtccggcctgttttgggctcagtaaaagctcaggggctctgaggtaattaggagaacagtttgggccacagctgcctgtcatgaagaaatcaggaagctgccaagcatcctctgacttggtttctactcaccaccaattatacctgagttagatgttggctttgaggtcctgagtggggaccacttccactgatttcctcttcttgggggctcttcagggtgcctgttggaacaccctgaagaggtgctttttaaggatgtgcttggccacagccactctttccagagccacaagacccaagggtagcaggatcaggagcacggggaggggcggggcagggtaggcactgtggtgtctgtggtcgttgtaattaggtgactgcctgcttccccaaagatggtggctcccccactcacctcccctggggagtctaacttggaaaataaatgattctctttgtcccttgagttacctgaaccttccccagcaagaaacaccccaggcccaggaggtgggtgctcagggagctgccttcatcattacaaaagtgcccctcttcccttctcctcctccccggctgctgtggggtggaggggctccaggctttgtcctggtgccagggtgagagcagccatcccccaccaccttgagcttattgccggatgctgtgcttgaaaaattttcgtggagccctcacccctctggcaggagatatttttacctgtctgcctcccagtcacactattttttctcctttcaagaagattcgcagttcacttgctccgacctccttctctcacaggagctattctgagctgcaagccacctctgttgctaagtgacaagctggcaccaagggccttctcggcactcgtgcccctctgcgctgtgctttcagggatggaggcactcctttcagagagtaccttgcagcttcatcatccgacgtgttgctcgtgaaagccacttcacaacccaccccagctactaagggggggataattagaatacggctgggctggctgtcaccacatctctaccatgctccagtgggctctcagctgatggagggtggcagggcagacagaacttacctttcgcatccattgttacaggtgcctggggcaggtggcttcttgctcacacccataagcaggagggactctcaacagatatatgctagagctgaagggggtcttggaggccatccatgccaacccattttacacacaggaaaactgagatccggagaagttagggcaatagtaccagtttgcacggtaggttggtcaggcccagcacctagctggcctgctgatgcctggattatggctggttccatgagatacatgggtacgggaagagaggaatcgcccctctcagggtccttctctgatcctgatgcttctcccagacaaggctttggggtcattggctgggtacactttggattcccaggccctgcctgctctaaaagctcacctttcaccagcacatggcttcagggaactgggggtggagcagggagggttattccaagtcactatttccactggggtatgaattgaatgagagctgaagaagaggtaccattcatgagcacttcttgggtgccggcatggttctaagaccagtacaatgtatcctcctcacagtatggtgaggtgggcaccgctggcaccctcccttgacacatgaggaaactgaagctcagagaggctagaaaagttgcccaggccaggtggctggcaagcagtgagctggggttggaacccaggccatcttactcctgagcaggatcaccaacccatgttggtaaaaaaaaaaaaaaaaaaaaaaaatggttttaagcggtctcaagctattccaaacatgaggtacattttaataacaataatgctaaacttttaatacaggccgtgtttttattaataataatattgctggtcttttgggtccaagctggtagctgcgggacctttgcctggcttcctttgacactggggtgtggtgcatggtaggactttctagggggtgccctaggtggacaccagttctggagaagaaagtgggcattgctgaggtggtgcaggatgcttctctccacccacctccactcccatggtcagctctccttggcctttcttgagaagaaatgggattgatgggaccaaatatcaatatggggacttacatattttttaaatgcataaaggtaaacaatgcaaggcttccaggcagtggctgctaccatttgggtcctttctgtgtgccaagctctatgtcaggcactctgtgtgcggctgctcattggaccctcacagcagccctccctgggagatgggagccatcattaaatgcaaccttttcacccatgaggagacagacgctcacataattaaagtgccttgtccaagagcacacagctagtgtgtggccaaggccccagggctgcccacctccctcagagcacctgccccagtcctcacacacagcacagccgtgctcctccctccccagcacacctctccctgtctccgcctctcattctgccccggggctctggccaccttgctcttcctggaattcccagggctgtttcctttttgggagctttgtgtctgctgttcgctctgccaatgctctttcctgtcattcacgcctctgctcaaatgtcacttcctcagagatgcccttcctgactgccccccaacccccgcatccagcataaaagagccacctgccagcttgctccacccctccggtgtgactcccctggagtcacatggagatacatggagtcaccccatgtatcacccctggccattacattatccatcgatttctttagtatccggcccttccacatgaaatgcaaactccacaagaggagacactttgcctgttttgtttgctgctgtatccctcacacctagaacagaggctggcatataggaggcactcaggaaatgtatgtcaggtgagtgagtgagtcaatgaatgaagtgagaactctcaactccaggcctgtctggcttcacagctcatgcctcccactcccacacccagtgatcttctccctgtgtcccccacctctactgagtctgactctgtcccagacaaggctctgttcagggtgttaggagaacctgagtagctttgggcaattcagttcctctctctgggcctcagtttgttcagagataaaatgggaatgttgagtcggacaattgctagggtccctcaagctttaatttctgagtctgaccctgttgtcacctgggcatattcactggacacagagggttccagtcatgactgcagcccagcccagtgcctcagcctggaggtttgtgcgagccctttgcatcctgcagacctaatggcacaggagttcttgggcccccatccctcagtgcgggatgcgcatggcgtcagtgacatcttgggaagaaggaggaagctcgtattagctgatgccctgtggttgctggatgctgctgtaggtatcctccttctgctttaccagaatgtcctggagtcctcttcttttaaaatgatgcttttttcctcccagccctttctcatcttggtgaccgaagctgccactcactaggctatttatggagaaacatgtgctccaattggtcagcagcaagataaattctgcagacttgcaggaaactcccttggttttctctagttgtggcttgatgatcagtaaatcatacctaatgcactgctctgatcaaaccctgctgcaggcagagtggctggagacaggctctgagccaaggaactctagtgattgcaggctccagagggacccccacccttcttcccagatctcatctttagtaacagctctgtatgtaagctgtaggggacggggagatgccttgacaggcagccgtttctctgtttgcatgccctgcagacggggacctgctgagtgaggagaggagctcgccctggcagcccaggcaaggacacaggcctctccgttgcgtaactcctagggccgtacttcacttgtgtagcacaggcaacacggcagccctggggggaggcccagggctgaaagttccacagatgcacaagtgccacccgtggggcaccttttaggatgcaatggggtgttcaactgacccactgggaagtgagtcccagcagagagcttcttatagggaattctgtggtcctctaaccaggctggccctgtcatagttaccccaaagcctaaccctgtctatgcttgaggtgtgagggggcagtcactaaagactcactgttcccttggaagaggagggcagcaggtgtcacctgctaatgtggtccaagacctggcctacggagggctagccaaccccataaacctcccagtttcattacatgtgtaacagggcctggctggcaggtctccttgatggtcaggccttggctggggtcagccaggatgtctgggtcaaggctggcaggaaggacgggcctggcccttgaactgcacagcagccttgcctgtgccattcaggtggcacgtacctacgaggagaacaaacggagcccagcttccagagacagctctttcccttaataaagtaattacagagctgggtaagttacatccctagaaagatgcagggcaaccgcaggctggggtgtgtgtgtttaattttaaatcctccaaccttcccttaatgagggggtgccttgaaatataacggaatggtggaattcttcaaaggcttcgttttcttggtgctttatttctttaagggaaagcatgaaagacaaatgaggactggcaggagtaggggagggttttgcctcctccgcccatgtcgtgcagacattatctgctgtaaaactgtcgctgaaggatggagaaccagctcttggctgcagaagtcctcagataatgtcagtgctgagcaatgacccaagattcattggcactgagcaaacagcccttggcttctggtgccagaatctttagctgagcctggtcaaccagtccagctaggggaatggagatgccatcggcactggtgtccaggggccccctggtgatggctcaagagccttttttttttttttaaatcacctggggatcctgtaaaaaggcagagattgattcaggaggtctggtgcgagcctaagatgcccctttctaaccagttcctggtgcaatccctgcattttgaatgaaaaggccctaaggaaggaaggcgctggcttccgtggcttccgccatgtggttttggctaagcagaacacctggaaggggaaggctgtatgggcctccaaaggggcttgagcactctaagctctgcagtatggaagagggaaatgtcttcacggataatgctctacttgggttcggagtatggctttgcctattttgcccctttaggtttacttttcaaataatgctcgggtcaagcctctggagaaactgagtctgtaggccttgagctcctcaccgggcagcccctgatggggagctagggcaagctgcatatatgaggcccttgacctgcctcacagtgtgatggggagttaatttgggttgtgtccacgttgggctcctcaccttcctggtgtggtcagataatcctttactgctcacctggtttcctaggtccctgaatgagaaggagctgacagcagctgaattccatcttctctgtgtgctggggagcagggctacacggcccaggtggcatcaatgccgaagaacagcaaagtgacccagcgtgagcacagcagtgagcatgtcactgagtccgtggccgacctgctggccctcgaggagcctgtggactataagcagagtgtactgaatgtggctggtgaggcaggcggcaagcagaaggcggtggaggaggagctggatgcagaggaccggccggcctggaacagtaagctgcagtacatcctggcccagattggcttctctgtgggcctcggcaacatctggaggttcccctacctgtgccagaaaaatggaggaggtaagagacagctctgcctgcatcaggggtcccctgcaaataggccggggatgaggggtaaaaaagaacacccctttgctgaggcagaactggagcccttgtaggttggagctcaggattccagagtaagacagcccaggaatagctataatgatggttagtagctaccaagagactacaggacatgataagaaagtgggctctggccccagactgcctgggttcagattccagccctgccaatcaactttgggacctactacaaattgcttaacctctctgtgcctcatctgcaaaatgaaaataatagtagctcctgcctcataggatagttgggaagattaaatgagctttacgtgcagaatgggcaacacgctacctgacacggtaaggagcacctgttggccattattactaaatgcttatgaggtactaggcactgttctaagggcttaatggatattagggctaagtgcctgaaactgctgatatttgagcatcttagaacaacaaagcaccaattttatgtgattcaaccatcgaatcctcccaacagccttatatgaaggagttgttatcatccttgttttacagactacaatactgaggcacaaattggttagataacttgttcaaggttgtgggtgatcaaggttacagctagtgataaagtcaggatgcaaacctggacaggcttgcccagagcctgggcacttagcctccacacctattgcttccgggtaggaggggccttcacactgccccctaggcttgaatccctcttgaggatgttgcccctggtatcaaaccactaccaccacttccagcccccaggaattgtccaaaggcagctttccctgaaaccagagatcaactaactaaaaataaagaaaaccccaataggctggaaacaaagagttttgcaagcccagacctctggtcctgggaaagtcaactagcaagagctcttgtgctcctgagtccctgtgcctggcatggcatgctccagcctgttgggtggccccagcttggcaggcattttaccccagtccttccttccttgcttgtggaactcttgccatgtaaccttttccaaagacgcagtcccctcctctccaggatgcatctttccctagtttagaaggccacatttggctgggaggcttctcctttccagtttcttttgaagggcagggagtgagaatgcccacctgaactcttgtgattgaattaggccaaaggcttccatctttcccccatagcatgttatattagctgcatggtctccttgcttgaaagatcttttttactttttaataagtaactgtcaatcagagcttgtggcctgcatggcatggtaactgagttgatgtaagactagcccaaagcaaagatatacaagtatatggtttctttatgccctgtgagatgttgagaagagctccaaggcaaccaaaatgacttcaaaggacgtgtggcattggaggacttagctgggaacttctaaccttgttctttctagcttagatgatcagttctgcctgggcacttggtgatgaattccagaatccctttctatgccacacacaagcactcacacccagggcagtgttcttgccacagtctgattgttcacagtgacaccaatcaccatggcaccagacataaagaactaccctagaggaaaagcattgtcaactctcagaattctgagctttccattccacattcctgccttcctttttctatcttctctgattcctgcaatccctttttatctctacctttaactgtccagtatttttacaggtttttctttgtttgttttttgagacagagtctatatcaagttgtcttaaatattttttaggaggaggcaaattatcacaggaaggagacagctgtttggtctgagagttgagtctgtgcttttgagccatagtcgatgtaatcaaactttgcatagttctggacagaaactctggaacactctccttagctccacgaaatgttgacatcttcctagtttgctttttcttctgtttatttttatgagaaaaaggcaaatgttcaaccagtgcttactatgggtaagccactcattcaatctttgcaacagccctgtgtgataggtgttgggtcaaagcttatgaaatggccatttttgtaagtcaaaaatggtcaaatatcagcaattttatacgtaacattttcatcctctttacccagatgagaaaaccagcagcacagagagattaaataattttcccaaagtcacacagctagtaagtcattaaaaccaagaggtctgacttcgggacctggctcttaccaccaagatggtcttttaaaccccaggaataacctcggggtttgccagaagtaaggcttagaatactgaccgaggcatagatgattagagatccagaaggcctcagagatcctggatcctggccctgtcctgataaatctcctaacatcctgaacagtgctccccgctattcggatgaacaactttaggctcctgaaagctgttgaaacataaaaggaaatccagttgtgtccccaagttgtattttctaaggcggaagaggatgctgttgcatttcaagtgattgcaacaaaggttgatatgaaaaaatacctcttattaaccacaaattctgcctatcttgaccgcggccccctgagcactctggttagtttaggccttggtgtggtagagagacctgcagtcacttcagggcctggcggcctgcctgaggtggacagagcctggatggtgaggggccagtaccttgtctttgctctcccacccctgtcactctttggcggcagttacctggaggctttccctggttctttggggagaaaaaagaggcatccatagaaggtgccaacccactttgcagacaccctgaaactcacatccctgcacatcttgccccacccagaacactggggcgaaatacaaaaccagtgaggctggctgggcgcagtggctcacacctgtaatcccagcactttgggaggccgaggcgggcggatcacgaggtcaggagatcgagaccatcctggctaacatggtgaaaccccgtctctactaaaaatacaaaaaattagccgggcgtggtggcgggcgcctgtagacccagctactcgagaggctgaggcaggagaatggtgtgaacccgggaggcagagcttgcagtgagccgagatcgcgccactgccctccagcctgggcaacagagcaagactccctctcaaaataaaaacaaaaaaccggtgaggctgtctccgtttgccttcctgcagcagatcacttagcttcttttccatttccccacacccaaaaccaagagaccgagttaaagacagacccaggggtctaagcatgtggccctttgggccctctctcctttgagccctctctcctttgagcaccatgatggggctgcttgttagtgacgagttgaatgtatgtgtgcgtgtgcatctagtgagttagatgctgtcatataaagctcggtgggttgcctccccgatgggctttcctgactagctccattggaccctggcccattcctcagcatgtatgtgcatggttggcttgtgtgactagtctgtggtgtgtgtgtgtgtgtgtgtgtatacatgtgtgctcatattgctcacgtgactctgcctgcctccccggcagatcgtgaactgttctaggatggtgtctgtgcctactgttactccactgtccccccgctgcctgtgcaaggctcagagtggacctgcagtaaatagctgattgttgccaactgccagaatttgtgcctaggagatggctgattgccagtgttcattggcagattgggcacacgttggtgaacatgtgggatgttatgttatgggggcagagcagtgtagctgggggcttctggaggctctctactggcaaggcttagtcagagggtgctgggtgaccatcagggccctggtgactggggctggcctgacagtgtttgacagacaggcagggccttgctaacaggactaggttgttggcacagctctcagcagggtgcactcatctgtgtccagacatggttttaattctcctgctaaatgccctgtcacttggaattgagattgtttctgcagtgaggcccaggacagcgagattaatttatcatctggaatctttagcgagacccattctatcctttatgatcctcctggctatgctttcctgaactgctaatttctctcccattcctctcaattagctgtagattagtggcaaagctggtcagaccccctctccctggagagcttccaagctcagcttccctggagctgcccagtctgctgtgtcagcgtctggttcagacgctgggaaggctgcacccggtgtctgtgcatctgggggcgagtaagcccccatgccatctggggctgcttctctgtggtcaggagggggtgtgaacagctgtccacggagcgcctcatgaggtgagtgtgtctgctgcgtgtggcttgacatgtggattctggagaggcagtgcaatgtctgtctgtttctgaacctagccttgtgagttgacatacatacacttcctcccttagtgtttcgggtcaggggagtcaagggggagaaggagggtctgggtgggctgctgtgtggtaggccacacgtatggccacatcattcatggaggagcaccgggactggtgacaatttgcggatgaccagagatgtggctgagactggaagacatggctgcggccccttccctcactctgctgctgtgctccagagcccctctgccatccctctgctctccccacaggtgcttacctggtgccctacctggtgctgctgatcatcatcgggatccccctcttcttcctggagctggctgtgggtcagaggatccgccgcggcagcatcggtgtgtggcactatatatgtccccgcctggggggcatcggcttctccagctgcatagtgagtcaagggctggggcaggcactgagtgggaggcagggggctgctcctgggcattggagacgaggtcaccgagtttccaggccagagtcctacgtcaggacaagggcagggagggggatcctcaacatgggaattactcacagctggggttccaggaccccagtcaccatgtttcctaaactgagagtcgaccacgttgcctgaaacagcatggaagatttgccattggtgctaaggaggaaaagctgggacatattcacatggggccgcctgggacagctcagccagagttctctgggaacatatggactagcccagatgcccttctctgcttatcagtccctcagctccccatgagggaggtccctcctctttccttggtcaaagagtattttaagcaggcaagcagggagctcaggaaaaggcaggcctggggctcagggtctccttgccattttgctatgccaaagagcagagttggagaacttacacaggaaacttaaggtcaacccaaggtgggtgaggctttggaacagtgagagacagggagacgccagtggccctggatggagaactttgtgaggtctccaggctcatccacaaggctacagatgagaacctgctcagagctctacgtgaggaaacagcatcccttaagggcaaagcctacagggaaccatgctcactgctcacacctgggataaagactgaaatgaacttctggaagggactaaggattctgccaggcctggcagtagggccagcccaaacttgcctcaggcagagactgggagagggcctattgcagccccctgctctcacgtcagccatcagctttgcactggccaatgccgtgtattctgctggggctggctgtgtgctgatacacaggagtgtgtgtatggtctcccacttggactgaaagaacccaagtaaaagaagtgggtgtctcactctgtctgtgctcccagaagggtctgctctatgagcagctgctcctgcacacatgtgctcaggtgagactgatgaagcaagcggccctcagctctcacactggcgccagtctcactgatgcaggagacagccaggcctctggaagggaccaccctgtgtccagagtggatgcagcaaatccctgcccatagaaacattgctttcaaagaagccccttggaccctcaggcagagtccatgcactcctattttaaataaaattctaccaatgttagttattgtgtttccaagaaatgacaagtgccatctttctagaggcaggctgctaacatgcccgagagagtggaatccacaagaaacacccacaaagtctctaaaagcacagcagtctgggtttgtttaccataggggccaaagctgtgcatgccttcacagtcctggagggcatctctgtcattacaatccccagtcatcaggaaatgaggaggagaaagtacttcaagtatcttagaagaatttcaaactggaaaggattaacattttaagagtttgttgcttaaaagagagaactttaacatctgaaaaattcctttgtggatttcctgaataccagatgaatggagcgtgaatggagcgtgaggggagctcctccacggcccgcaccctatccctccttgcctctcttgaggctgtgctgctgtgtttatggcgctgccgacgtgctgggcctcgggtggagcgtgggggcagggtggagttgcctgcagcctcagtgaccccgcagtgggcttgtccccaggtctgtctctttgtggggctgtattataatgtgatcatcgggtggagcatcttctatttcttcaagtccttccagtacccgctgccctggagtgaatgtcctgtcgtcaggaatgggagcgtggcaggcaagtatggggcccagctggggatgccagccagccctgtcccaggaaggggtctcacaagcttagcgcacacatttggaatttcagacttgttgtgtccccttggataagtcacttaacatctctgatcctcatttccccttccccagtgggaatggtctcttttccagcctatttctgacaggattgaataagacagtgagtgtaggtaaaactctggaaagcgtgactttaactgttattactcaccctgttattccacttcacagatgaggagactgaggcccagaagcgactttcccatgttcacaccactcatctaaccaatgatctgggatgagaatccaggtctctagctcccagctcaggaccttccccgaggaactttaggccaattcagcctcacgtttcctcccttccatagagagacatgggcagcaggaggcatgggtgggaatcagccaggctggtgtgtcctgaagcctcccagaccccagtgggagcctaggattcctcagggtctgccagatcccggctaacccaagatgagcacagcccctcccagctgcccaccctcagcagctccctcacccactgctgccctgagtggtggtccagcagaggaagtgaccccataggccctgccactgaggccctgtgacctttgctgctatttcagtggtggaggcagagtgtgaaaagagctcagccactacctacttctggtaccgagaggccttggacatctctgactccatctcggagagtgggggcctcaactggaagatgaccctgtgcctcctcgtggcctggagcatcgtggggatggctgtcgttaagggcatccagtcctcggggaaggtgagtgctgaggggggcacccaggacccaaatggggaacagcagaaaggcacagagggcacagggctaagaattccaggctgccctttgcagggtcttctgggtggataacacaggcccccagaggagggtgtggaagtatcattcctatagtgttgctcaccatggacagcctacccggaatggaatagctggaaagtcattgccctggaccccagctgcttccatgctcagataactcagtcctgctctaatgcaaacattagagaggaggaaaactagaagtattgacccagggacgtctgtctagattctagaccctcaggttcccaagagcaaaagccctagaagagcctgctttgagcagttcttggtgaaaaccagcagcttgccatgcctacagctaaagggccctttgagcaggtagacgctatgagtgaagggggccttagaggcctcagggggcagctccatagcagtctctgaggggtagaccagccaagccccacacctcttcccagcatttcagatcccctttaaataagggccctttcttacttgtcacataccagtattcatgggctgccagggatgagaaggattggattagagatcctgtatcccagactactcattttacagatgaggaaagtgaggcccagagaggggaaagcacctcagctaacatcacgcagccagtcagtctcagagctgcaactagaaccctggctgtttgaggcttcgggttcttttccagatttgatgagcaaggaagctaagctctagaaaggtagagtgaccccagccattgacctcttccctttccagaggctgaaatagtagctgatgctttgtggcacttctcaggtactgccacctgtatgaacgcatttggtccacaacaacgttatgagttagggatgattacacccattttagagatgaggagatggaggctcatggaggttaaatgaaatgcctgaggccacatgttggtaagtggtagagccagggttagaactcaggcagcctaacaccagacttgcattctcttagcctttacaccaccctgcccaaacagccctcttcctttgtttcagtgcagcaaacattttgtgagcatctcgtgtgaggccatgtaccacgcacgcagggatatagacatgtgcgagaaatgctgtggtagagaagagcacacgattcatcctcacaaggggctagggacttcttcagatgtcttctgtttgggagccgtgtctataacctcctgaaggtcttccgtcaaaggagctctaaggacaggggagatccttagggggcccactgggggaatgagacatgggagaatgaggaggggacagcaaaggactcccttacccccttggcagccctctggggtgaggaggctgttagctcagccccagaagctctggaagggagaaaaccaaccccgggcacagccatgcagactccagcttgtcctgttcctgcttctgccttggctccatgccagatgtgtggcagttttggccctctgcccaggggttccagggctctgttttctgctgccatcaggggcggctcatgtgccccagatgtgagcagggatggggggtgccagctgcaggaagggctctgcctgatgggggttccctgtcctctctgcaggtgatgtatttcagctccctcttcccctacgtggtgctggcctgcttcctggtccgggggctgttgctgcgaggggcagttgatggcatcctacacatgttcactcccaaggtaagggtttggggctcccacatgccagggaacagcaacaggtctactgggcctggtcagcttcctgcaatttcatggaatttaatgcactccgaacacctgctatgtgttgggtatcgtaccaggccctggagagatgcacagggaagggggcatgggccctgccctccaggttccaaggagaggcgtgtcacatcgatttgggtgaaattagaaaaggcttcagagaggaggtaacatctgaaagagccttagggagcaggtaggattgcagtgagctgccataggacattataatcaaagggaactgcatgagcaagggtgtgggaaaacactgggcgtgcttgaggcaacagtgggaagtcaggtttagctagggtatgagagcagggagcttcattcattcattcattcatgggggctttcattgtgtggcagcaggaaccaagaagatgcctaagagaagaaagctcctgggaatctccccttgtacccaaatcagaggaaagaagttactattttattaaagataatagactacatgagtggtgactttaaccttaccaaagccattcacacttcctcttaattctctcaatagcccggggagcaagatgagcaggatcactgttcacatttcacaaagggtgcagcagaggcacgggcatcctgaagatgtatacccaggttccctaaagacggtctgtctccacccatggccttgcctctctatgacccttcagaccactgggcacaactggcatgcctcagtccatggaggactaaaagattttcaaatgcagattggcactccctctaagttgccccaagccctgtacatcagaaaccccagctggtcaggctgagagtccatctctaaatgccagctgatcagtagcaaccagcagggacctggtgagactatagcccatgggcacagggtcagagctctgtcaggccagcttgaaggcctcagtgttcattggtgccaccttgcacatgtgtgtacacacacacacccctttacacaaacagttcatgcaggatgacacaggaagaagaacccagatctgatagggttggaaatccctgtaggctcctgatgtctcaggggtagtactggctagggcacacgccactccatagtcaccagacagtgcctaaatggtccctcagtgttcttggatataacatcagaggtttacacgtgaccaacttcaaaggtccactttatgaagcacttaatgaatctcctgaggcatgaatgtgaatcctgagccatgtggctggccgtagggttgttgtaaacacatgatatctgacaaagaaaaaataaaaaacctggtttctttgggagaaaatagccatgaaaagaaagccaactgtttttaacagattacaactgtatttctagaaccatgatcagtctaaaacgttcacttcagttttccaattctactttactaaactttaggaggaaattatatgctctggtgttgttcctgagtgtggacttttacagaggtctccagatgggcccctcaatgttgttaagggccccctgtatgtaactctaggagcaagaggaacagattcacaggagcagctgctggtcccaacacacacaatactgctccccactggattcagacacactttatctctttaattatgaaatatctcaggcatgtaaacacatatctaataatagaataaaaattcttaggaaataaaatattacagatgccattaaagtgccagtgtagccctccctgatcccattcccttcccttcccaaagatagcaactgtcttattccattcctgctgctacaacaaaaattccttagactggataatttataaacaattgaaatttattgctcacagttctggaggctgggaagtccaagatcaaggcacccagcttcagtatctagtgaggactctctgcttcaaagatggtgctttctcactgcatcctcacatggcagaagttcaagggagctcacttgagcctctttttataggggcactaatcccgtcagggctccaccgtcatgacctaatcacctcccaaagacccccacctcttaatctatcacactgagtattaggttctgtcatgggaattttgaagggatactaacatccagattatagcaaccactttcctgaatttgggatttgtcttgatcatacattctttgaaatttgttatacatatatgtgtatccataaacaatgtttagcatttctgcatacctttaacctttacataaatgacatcatattatatgtattctgcaacttgcttttatttttgcttaacatgattttctaagatttaccaattttggtgtatagctctagtgcatcagttttcatggatgcatagtatttcgctgtaggactaaactgaaatgtatttattcattctctagtaaatgatcatttaagttgtttccagttttcaccattgctaataatgttacaataaacactacgcaggtcttcatgcatacatgtttctctagggtatctatgtttaggaatggaattgctgtctcaaagggtatgcatatcttcagtcttattcaatgttgactaaattgcactcccaaatggttgtatctgctaacactcccacaagctgtacatgaaaatcccagttgttccacatttgtcagtcttcaatttttgccaattaggtggatgcaaaatggtttatgtacactttgagcagtagggggtgcttctttccttccttcttcctttcccttccccttcccctcccctcccctcccctcccctccccttcctttcttttttgagttggagtttcactcttgttgcccagtctgaagtgcaatggcacgatctcagctcaccacaacgtccacctcccgggttcaagctattctcctgcctcagcctcccgagtagctgggatgacaggcatgcgccaccacacctgagtaattttgcatttttagtagagacggggtttctccatgttggtcaggttggtctcgaactcccgacctcagatgatccgcccgccttggcctcccaaagtgttgggattacaggcgtgagccactgcgcctggccttggggtgcttctttctaaaacagtttcctggatgttcaggaaaccatgtgaatccactttggcatttgcagaggccagggtcttcatgagactttaaaaaatcaaatccaggagccaggcacggtggcgtgtgcctgtaatttcagctacttgggaggctgaggtgggaggatcccttgagtctaagagttagataccagcctgagtaacaatagtgaaaccccatctccaaaaaataattaattaaaaatcaacataaaaataaagtgactctcccgaagctacacagctggcaagaagcagaggcaaacctgaactcatgtccacagactccacatcccatgctctccagctgataaactggcttcatgaaaattggtggctgaaggccaggtggcaagagtggagggttaaatagaaacgtcccctaccttacaatttcatctaaaatcattccttcttatattcctgggaatggctaaaaacaaacccacattttgggggatgggcaggagaggttttgcaggaacaaaaaccccagcacactactgctaatctgcctttccccatcttacaccccatggttgagctgagctggctgagaaggaagctctggggggctccatccaagccccctcagggagtcaggcaagtgaggccaatggtgatggctggggtgaggttcctatttacaaatccctccaagtcatttgcagaaagggtaggccgactctcagaaacaatggcctgacagtctatatgtggcaaactactgttgcagagctgtgactgttttcagcacaggattggggagatatgaggggtcctaggagccatttcaagttcttgccctacaatgatgctgtaaagtaccaggtcactgccctagctgcccgtgctgtgcactgctccattcatatagactataatataaatgacatccccaggggtcatgctgtttggtacctctggcagagtccaagaatttttggccagggcatctcagagcccatgtgggagaagcataggctctccatagattgtgctaaatgacctggaaggccttcccttccatagagccttccaacatcagaaataattcaggctatcggacctggactttgcagtccatgtcttcaagcagacagttaccgggtatgatgaatgcgatgtggccaagctgccatgatgacccattagcatcgttggtaggacagtaactcgtgttgacggctaatgaacttcttgaattcctcgggcagcttttctcctgattactttctttccatgtaggtaaaaacccaggtcagcatgggctacctgcaattaatcatgtgatttgcttgatataaagtggtagattatggtcggatttttaaccaccaaaatgttcagagaatgtttatcaaaattacaactgttcatatccttcagcccagcaatttaacttctacatatttgtcctacagatgtactcatacgtaagcaaaatgatcagtgtacaatgttgttcattacagcatttgttttagtggaaaaagattgaaaacaacccaaataaccatcattcacttattcattcaacaaaggtttattgaacacctgttacgtgcactgttccgagtcacgggatccagcagtgaacaaagcagacagacttcctggtcctcatggagcttacgttctggtggagggagacagatgttgtcagataatataagataaagaattgtcattaactgttgatgccaaggggaaaaataaagcagagaaaggaggtttagggcattcggtgagaagagttgcaattatggacagtaccgtcaaggaacgccttgctgagaagtgacgtatgaatgaagacctgaaggaggccagggagcaggctatgtggatatttagaagtaatgcattccatcctgaacagagggaacaatgagtgtgaaaaggacttgagactggctgtggctggcatattcaaagaggccagtgtggctcgaataggaggggaaggaggtaggacgtatggtcggtagtaatgtacagccggatcatgagggtcctgtggttaaggtaagaagtttgacatttactctggtgaaaagggagccatcgagagttctcagcagaggagtagcatgatctgacttcttaggacgatcattctaagcctcttaagtggcttctgtagaaaatctgagggaatgaggacaggacagggagacctgtcaggaggtcctccaggtgagagatgactggggtttgagcccaggtgatggcaatgggagtgatgagagttggttcgatggaagatacatttcagaagcagagtcaaaagggtttgctgttggattggttgtgaggtgtaagaggaagagaggagtcaaggatgactgtggccctttacatgagcagttggaaggatggaattgacattcatggagatggggaagacagtggagggaacagatttggtggggaacatcaagagtactcttttggacatggcaggcttaaaatatctaatagatctccacatggagatgctgaggaggcagttggatgtatggatctagaggtcaggtgtggaggtctacatttgggagtgcgggataacagagagaatttaaagccacagattggttcacaatcacctagagaatgaacaaagacagagaagagagctgagcactggggccctggtgtttagaggctgagggcgggatagctgtgggtgggcggtggcggggaggtcgaagaataggagcagagagagagacaggcaggccgacagacaaacagacattctagatgcagagtgaagaaaatgttttaagaaagagggaacaatcagccatgtccaaagctgctgagaggtcaggtgatgaggtctgagaattgaccgaggcacttggcaacagaggggtcactagtgacctcaacaagggctacttgggtggagtgctgaggacaaatctaataataatgggttgaagggaaaatgggagcgaggaattggagacaagtaatagataccagttattctcaggagttttgcgatacaggagcagagaaatgagaaatgggatggtaactggagagggtcatggggtcaagggtgttatttcacaatttatatgataaaaataatccatcatacaccactggtgggaatgtgaaatggtataatggctttggaaaacagcgtggcagttcctcaaaaggttaaacagagttagcatatgacccagccattccactcctaggcacatatccaagagaactgaaagcatgttcacacaaaaacttatacacaaatgttcatagcagcattgtgtattatagccaaaaagtagaaacaacacaatgtccatcaactgatgaataaatttttaaaatgtggtatatgcatacagtgggatattatccagccataaaaaggaatgaggcagtgatacacattgcaacatgcaactcctgaaaactttaagctaaatgaaagaagccaaacacaaaagaccacacacggtatgagtccaatgatatgaaatgtccagaataggtgaatccatagagaaagaaggtggattagtggttagtactgggcttgtggggaggttgggggagacatggggaatgactctatgtgtttgggttttctttttggggtgatgaagaggttttaaaattgagtgtggtaatagttacacaacagtgtgatacgctaaaaacgattgaattgtgcacttaaaaaattcaaaaaagagaaggtagtttgtgtcataggagaggagaaataagcaggagggagagactgcagtgctcagctggaagagttggtctcagctaggaccacacacagtccccatagtagcaggagggaaaggctgggccacggcgcatggacgctggcaggtgagatgctgtgggaaggagctctcttctgattgtgtcatttttcgcagtgaagtaggagacaaggtgattgtctgagagcaggaagggaggaggaggacttggagggctaaggaggagtgagtgtgaagtaactgtgtaagagatgggagaaatgtgtgggcagtggcagcacgaagggccccctggaggctaggggtcaggagtgtgcagtggactctctagcatggagatcgccaacacttccgcaactccaagatagacagtttttcacatttgaacatctctgaaagcacgctgtttccgacgatcagtgaggcaattatacaagcctgttttttctgtttttgttggttttttttgacggagtctcgctctgttgcccaggccagagtgcagtggcgtgatcttggctcactgcaacctccgcctcccgggttcaaacgattctcctgcctcagcctcccaagtagctgggactacaggcatgtgccacaatgcccggctaattttttgtatttttagtaggggtttcaccatgttagctaggatggtctcgatctcctgaccttgtgatccgcccacctcggcctcccaaagtgctgggattatagatgtgagccactgcgcgcagcccagaagcccgtgttttacaatggatagtgcttattctgtagcaggcacttttgtgtgcactttgcatatataaacccatttaaacctcctaacaaccctggagaggtcggtactctcattatcaccactgtgcagatgggaaaactgaagcacagaaagggtggataactgtagggaggaggctatgagtgggcaacagcagaaggggcagtgtgccaggagctctgggactctgtgggttcccaacttagcatgttgaggaagtgccgaggctgggagcaagggcagtggccccaggagtgtggagagttccatgaccactctgatgtggacagtagggaaaaagaggaacacacccacacatattcacgtgcgtgtatgtatatgtgtatgtaatgtatgtgtgtgtgtatactgctggtatacgcataaaatatcacaggggggtacaccggaaactgacatcatgggtacatctggagaagaagaaccaggtgttacaggatacagggatgaggaaaaggagactgagggatcggggtgtgcatcaactcctagagaagagaagtgggttctctgcaagttctgaaggcccaggggtggaggttaggggtggagcttcttgactcccacagttagagagagggcttctcagcaggatgatgaaggtggcccagcctcattaccagagcgtgggctctggagccagacgatctggttcagactctacctcatcactcagcagttgttgggcaagttcctttgccctgagggtctcagtttccgcaatggcaagatggggtggacagtggcacctccccaatggggttgtcgggaaagtgcttaggactgctcctggcaagtggagagcatgtggtaaatgttagctattattatcctcgtcccttgtgaaggtgacactgttcttgggcagcgggagcccagtgctccagtgccatctggtgcttcgtggccccggctggctccacaccagcaggtgcacagcagtgctgagaagcaaggtgtgtgctcctgtcacgcatgcgctcaggctagggctcagcagctgcttgtgggctcaaaagcatcatcatgcccacgagtcaaacgccttgatacactttgtttccctgagtgaggaagtagttcagccatcatgctgaagaattggcaggaagctgttcctctgttttagagcagacaccccgaggagggggcgagccgccttttctgagggaaaagcccattgcccatcctcctcttgcagtcacatcctgatgcctggaaggggcgtggggttttctgaatctggccgggggttcatcctctgttgttgcttgttagaatcatgcaccatcacccaggaatcctggaaagagcccctttaaatgcaaggaacaataagcattctgtactgaaggtgccaggctcaatttacccccagattagcactgggcatctgtggtcatctccatcagcaagagtacccctctgagctgcaggctggaagggagggtgcccagggaccacctgcaccaggcacttttctcctcaaaggtcaagttcaccctcagatgctttcctgggccctatcaacatcagatttggttccatcaatttgctgggtgatacgtatgtgggtgataggtattcattacactatcttctctgcctttgtacattttataataaatattccataattttttagtggaaaaagagcaatcttaacaaacaaattttttttctatccaaagttgttgaatattccatcctccaagaaatctccaagctatatagggccagctctgatctgcagtttgggattgtggtatcctcccaggagtggctgcctccatttatgaaatttgaccctgaagtgtgactaggctgaggaatttattcacatctttattgatcctaaaccttttaggtttagggtgtgatggaaatcttaatgatggtatgaatttgggtctcacaggtagtctggacctttttgtgaaaatgattgacatagataaaaaaggaaataattaccaaaaaaaaaaaaaaaggaaagagaagaggaaaggataataaaatgaagccagtattaaaatagccatgttttagaaagtagaagtttgaagtcctaagatcgtcctcttattctagaagacagcatcttagcccaaaaggctggtacaactttgtagccccttgtctggtccctcctgctcagctcacaactcatagaaaaaggtcagcttttgtctagtctctctctctctctctcgctcccgactctttccttctctcacacgtgccagcactgttcatacaaacaggagaggagatgggctccacccctaagcacaaagtgttgaaaggaagacgagacacataaacctgtgacgtgggtattgacaagagctgtgagagctcaaggaccagaggcaattaggaaaaactttaaagaagaaatgatattcatggtgggttttgagaaatttgtaggagtttaccagaaagtgagtaggaggaagggaatttcaggaaaaaattacagcctaggcaaaggccagaggtgtgcttttgaagaggagtaagttacctgcatgtagaatgttcagaacataaaggaatggaaaaagattttctagaagacagtggggaaccatcagatatttttcagcatgcaagcgacgtgaccagagctgtgttcatcttgttaaaaaaaaacaaaaacaaaaacaaaaaaccacttcagctagattaaatgtaaaagtttaattgagcaatgaacaattcgctaatcaggcagaacaattcgctaatcaggcagaacaattcgcgaatcgggcagccttccgagccagagtaggttcagagactccagtgcagtcatgtgatggaagaagatttatggacagaaaaaggaaagtgacttacggaagatggaagtgaggtgcagaaacagctggattggtcacagcttggtgtttgccttatttgaagttggttcgagcagttgaccacatttgattggccaaaactcagtgattggcacaagggtaggctacagtctgtttacacctccacttcttacagttcatgatgtacagagaaacctttaggccaaacttaaaatatctaaggaggcagctttaggctaaacttgatttaataatctcaacataccttcttttagaaaatttcataattcttcctagttagaactcaccaaactgctcagagccctcccatgaggtgctggtttctagcctaggagaagcgcccaggctccagcagattgtggtagggctgttgtgattgacatttgcgaataccagaggaggccagccagcatgccttccaggcataagtcacccttatgcccatttctggagcattcttgaaaaattatttttcaaaaactcacccaagagatgggaattaacacaagtcctttcccagtggaactatgattgttttcttctccttttctattctccagatttctactaggcacagtacaggcccccatttccttatccacaataccaaaatccaaatagccatgaaaaacaaaaattggtttggtttggttttgatcctccagaactcacttggaagcaaaatgacctgcacagatgtgaggctatttatagtctttattgattcacttggtgtgaatattcatattttgctgcagaaatactaacgtgtttgattacagggtgctgccccagaccctgctgggggtgatatgtaattaagtagcatatgcatcacattacctttctaaaattaaattagaaacaaaagcttgtattccaaaaccagtcagcccccagggcttttagataaggaaccgtgggcctgtattacatttgtaaagaaggtaacatttcatcttactttaaaaaccagacatccgcctatgcaagggggtgggcccccagcagtacaggacagccctgccctgtttctctggtcacctggctctcccatgctccgctgtggctattttaaacccttccaatccttcacaccctctgaccttccttccggcatactcatccccagcagatgattttgcctcctgctttacagggaaaacagaagctgccaagaaactccctcagatgacagagacagaaaccgaccataaaacctgcctgcagctgccccatcctgtcctccctccctcctctctcaaatgagcagcccaagggtggtcctatggaggacagcttcccaccccatcccgatccctaccctccagcttttcaagacactccattgaaaacaaaaacaaaaaagaaatcaagacaacatataaaaatgcaaccctttgttgatttcatagccttctccggatactgcccttctcctgatccgaggcttgcttctccgaggacctgcttacccacattgcctccatttcctcccctctgcctctctcttttcttcacttcccctggcttcttgccagggagcaactccgaggaagcctctgaagccccctgtggcctcctgcgtggactccctcagggtctttcactggcagcactgacccttcctcctccaggctctgggttttcctcttgcctctgctgcttctccttctctgactccctttcaggagactctccctcttccctgcattcagtgttggagataggagcaggcttttgcttcttatccctctgtaactacagccacagcctcagctcctgccagcacacctgctactcagaaagtctatctccagcttgtctctctctggctccaggctcatctgtccagcggaccacttggcatttcattttagatgtcttaaagacacattcagctcaacctttgtagaactaatgtcctgatcctccctgcccaacaccatcaacctgttcctctcccactgtccccatctccacctgctcaggtatgcaggccagagacatggccctcacctcggcctctccctctccagcatctcccatctccagtccatcccgaaggtctccttggtttgtcctgcgaagatctctccattggcaccacccagccccttagcaaagccactgtcccctccagcctggaccccagaagccgcttcctcgaaggtctgctgaatccacttatttcttttggaaatgcacatgattgtgtccccacttctttaaacccctcggtggcttcttgggttaggtgctttcttagggtgaagacaggatctgtacaggcctttgatctaacttctctcctctcccagccctacctgtgccacccccacctcgtcctcactgcttcagccaccctggcaccttccattcccttttacacaccatcctctgtcctatctcaggacctctgtccatgcttcttcccgaatgttcttccctccccttgtggcctcgctttcatcagctttcaaatgtcagcttgaggaccccttcttctgggaagccttgcctggcctcccaacttgttcagatccccttcttatgggctctccaagcactgggtgcccagccttcacagcccttgtcacatttgcaatttagcatttgttcgtgggatcatttgaccaatgtgtctctctccaactagaatgtaaacttggagagcctgattgcttctattccccatggcctctgcatcgcctagcaccaggcctggcccacagcaggtgctcagagattgatggatgagtggctacatgtcattgccacagggaggccttgacaccttatacctaataagtacacaggggtgggctggggagagggtctcctcatagatgccaaggggcccttagatccttaaggcctgggttctgggctttcttggtggactaaagatggttttacttattttgtgctggatgggggaccttaatctcccctggagtacacatgctgtctgaccaggcagtcctcctgggtctccatttgtgcccaggccctgaagctcaaaggctcgactaccatcccccacctctttcccctcagcatgggggtgccgccctcagcctcactgctctgccagcgctctgagcttgccaacatctcagctgttggagtgctgccaggagttgagacatgcctaggaagctgctgagatgatggcaggtgggccctgtgtcctggatgttatttagggctgtgatattaaagacagctaaagtccagacggaccctagagtccaacacctcactgttcaggtgaggacttacccacaggtactcagaaggggcagccgggccaggacccacacagggcttgtcaccacagggaagtgaactctctgaattggctccttgcctccttagtctgtctggagtgaggtcacttaggttcacctcagcagcaaaggtcacaggggaaaatgctttaaagagtataggtgatagaaaaactgagtcaggagttggtgctggggccgggggcgggggcctggcccagaatatctatattttagttatcactctgccccgactaaccagctccattaccttgagcaagtcatttcatctttggggtctcagtttaccctttaaaaacatgaatagtaatccttgcttcctgcacccccgcaaaacacaaaacaccctgtcctgacgaggtcagcctcattctgttgggattgagtgccactacgtacaggcattacttgttgctatacatttgatcctcacgttcactccgagactctattactattcccttttcttcagatgagtaatctgaagctcataacacagtcagtgccacttaccaaaagcttcatagccatttaaagatgggagtcaggatttggatctggatctgtctgagactctaaagctctgtgctgggtccaaggcttggtccctgccccaaggaacaaacaataaaaggaaaataggttggaaaggggctttggaaattgctccatgccatcccaatgctgttgcagttcgggctcctgtcaggtgtgagggcagatggaagcttaggcggaggccctttctccaggaattgtctaggttctgtgcttcaggttgggtgatggtggggaaaagcaggcggtttgggttttttttcctttcatgaggtagaggagtttgaggtggagaaggcgtcagggagattctggtattctcagttttcttgtgctgctgtgcaagctgttcactgcaggactctaggaggcacctgtcacactgtagtccaagtgaatggcactctctagagctgtgtactacatgaccatatgtgatggccttgacgatgttccttagtatgatggctgcatgggaagccatggtagcagttaaattactatgtaagcactcagcatttatgttgtcttaccaagtcctcacagtcatcctctgaagttgatactcttgtgatctgcgtattggggaaactgaggctcagaggagtagggaaattgcccaagttcacacagcttcttaccactatgggctgctgcctctgaactctgttgaggctgagaaagggggtgtgcacatgaataaaaccatcccctctgtgtctcttttcttcctcctgccttggtcttctgccatagctggacaagatgctggacccccaggtgtggcgggaggcagctacccaggtcttctttgccttgggcctgggctttggtggtgtcattgccttctccagctacaataagcaggacaacaactgccacttcgatgccgccctggtgtccttcatcaacttcttcacgtcagtgttggccaccctcgtggtgtttgctgtgctgggcttcaaggccaacatcatgaatgagaagtgtgtggtcgagtaggtggcatctctcctcctgtccctccttctccctgtctaccttacctgggagtgggcaggggtgggggcgcaggtgtgcatggggagagaggtcccctccactcagactgaggaatggagatcagaggagcactctctgtccccagctccgggccacagggacaagctcagagatgcctctgtcagtgacccatgaggttcccacctgggtgcctgggaagagcctccaggatctcacccattgcccacccctgccttcttacctggtcctctcggttttgtgctgcaggaatgctgagaaaatcctagggtaccttaacaccaacgtcctgagccgggacctcatcccaccccacgtcaacttctcccacctgaccacaaaggactacatggagatgtacaatgtcatcatgaccgtgaaggaggaccagttctcagccctgggccttgacccctgccttctggaggacgagctggacaaggtgcggggacaggctgcccttcccaggacaggcaggaacccagagagcagctgtggccggcgggagcttgggctcaggcctcaggatgctgacaggtagtcattagtttacttggtaagcaaggatctgctgtgtgtccagagggagtgaaagggaagaaaggtattggccaaagtccctgcccagaggtaggcttgagcctagacaagaagtagggcagacacacacctctcagaagtcacagtaagtgtatgggacgatgtttccatttactgagtgggcttctcgtgcatcagtcactgccacaggtaatatactcagaacagtgccttgacatggtgtgcatcaaagaagtgttgaagttagtgtttgcccgttgctgtctatctcttttgacgctcaagacagctctatgagttgagtattcatattgttccctaccttacagatgagtagcctatgagatggggggcttgatcaaggtctcataactagtaagtcagagaggcagttagttgggtccaaatccagttagttgggtccagagcccatgctcaggatcacctcttgatgcttctgcccctccccaacctgtccccattccaatctcactgccatgatgactcttagactttagggtggtgctgggggtgctgactcctcctcagtgctcaggcccatgttaggacaccttgcttctatttatacttacatagctggacactttcaaaatgactgttctgttagaaggggtaacaggaaagggacatacccacagcatcttgggaaccaggctggagccaaggctcacatggggcggagccagctcccatcagcctgggtcaaccctgtccttcatgggactggggaagggggtgctttccctgggctctatgttaaaagtcagctccattggatggtaccatcctaatgctgagggagctgcatcctacaccccaaccctttccctgcggatcaagagcaaaagagcccaatctcgggcccactgccctggtttcttccccaggtaactggcagcataaaggacctccccttttcacattctctgaaaccctgctcagttctcatgggcatggcctggttctctgaattaaactaggtttatagcagtgttttcatacaatacaactccgatagcattcaaatgacaagattatacactcacttagtggggaagaaatgttcccttacaatcactgaacattacagggcaacgtgtaagtgacagggggcagtgtgtggtcacctgacccacaagcatggcccaagcattaaagcagtgattctctaccttggctacccattagagttcctggggtatttttgtttgttttaaaaaaaaactctgacacccagcttcaccccagaccaatccagtcattgtccgtggggtgagacccaggtgtcggtgtttctaaaggctccggtgtgcttccattgagagccgaggctgagaccactgcatgaagatctgcagttcagaagttctgagctgggagcggccacagtgtggctggagcaatcaggaaagacatcttagaggagcagggtcctgagctgggtgtatttctaaacatgagcatcttcacttgaatcacctaagctcctggtacaacccgtagattccaggtcccacaggtgaactcccaagttggtgtttttgagctacgtctaggggattccaatgcctgctaaagttcgagacccactggccaaaatcaacaggatttaggtggaggtgggaacccctgtgaaagagggaatagttattccaaaagtttgaagggcagagggaaggaagcagtgggctccccagggaggggtgacctcacaggccctgctttccaccccaccttcagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacaggtaactcctccctgcccccatgcccaggctctgcaggctgcccttgtggacaacaattccgttctggcttctgactgggtccttcatgaccccacacccagaaggctccaccccacactgggacacagctggagcctggctgtgccactcagtgattagcactcacaagccaggaagagaaagctacttggaaatctggagcaaacatgagccgggaggcctgcatctaggcccctttgttagttcacttgcccctctccccaagggcctgctgagtcgtcttgggaagtgggtgctgagtcgtcttgggcaggggcactcactggccttgcgccctgttccatctttgtcactccagtcccgggctgtgtccacagttcccttcggggtttgctgcgttgatctagggcccatagagggatacctctcatctgcatccctaaagcggggtatctttctgttctcaagtggggaaactgaggtggagaaaaagactggtaacaatcagatgaatcatttaagttaaatacagcaattaagtagcgcacctgccacgggccaggccctgtgctggggcagaggcatgggatgaaagttagacacaacgccttcctcaggtgctccccgactagtagagcggggctcagaacctgagcatctggatccctcgtgcaggactgagcctgctggcaggagggctgcaggcatgctttggggagggatgtgatgggaggggcctgggtgcccccgagacccccagggccctgcccaccctgcacctttgcccccaaaccggcctcccggctctctgtagtgggctgctgtgtctttgcattcctcgtggggctgttgttcgtccagcgctccggaaactactttgtcaccatgttcgatgactactcggccaccctgccactcactctcatcgtcatccttgagaacatcgctgtggcctggatttatggaaccaagaagtaagaggaacatgggggaaaggtgggatgggaggaggggtctgtcctatcatgactccctggagaggcagatcatagagtcacaatggcagagctgaaagtgcccttacggatcatttagggaaactgaggtgtagtgcaaggacatggctgcctaaggccacttgtccagggagaaacagagccagtctgaggactgggtgtcctgggtgcaggtcctggcatcatccttaaattaccacagcacctttcctgggtaccaactcttcagaactctgttaagtttttgtgaagggcttagtgggtctacaagaggcccttgccctccaagaacgtgtagacttcagcagcctggttcacaattgtaagggcctagataggggtatgagatgaggtatgattttggccccaagtttggggttgtgcagggtaagaggattcagctctaagaaaggattgggtctcacagcctaggcctagggcagttgtacacttactgtaaactcttggcctcatccctcatgttagggcaaatacgtgttcccaggagttctagaactaggtctctctgactcactcagcatcgaccatgaccacattgtccttgtccttggcaagacccacctccactaacccacttggtctgaccctccctgatgcctggacctggtttggcagtggggctctttcacaggggccgtctgcttcctaggagagcacaggaggggacagggagtggggggaaggacactcctctgcttccacctgctgtgggccagggctgtaagacactgccacaaaggactctggctgatttttgtgtcctggactccttcggcagtctggtgatgtccctgtatgttactttaaatgcataagataaaatgtgtagggttatataagaaacttattatattgaaaaatagcaaaatatcatttaaaatttgtgatatagtaatgtatgagcactttatttttaatgcattgttacaagatctagctatagatctaataacagtggtaactttgaagtagtgatgaaaatcagcgatgactcaatattttcaataactgggatgtaatatgaaaatatctgtaatctattggtgacagtcacaggtattgttaatactactgtgtttgcttgcattcataatataatagaaagtaatgcaagattttagttagcggttattgaggtaaagatgattcttttgtatgccattcaagcacaagcctgcctgccttccagaattctgctcaccccttggtgagaaacccctgagtcagggcagctctctacctttggactctagagaagtgcacttctactgcttttccagcagggggagccttcagccaggccagtgtgaaagggctaggcccctccctgaacacacaagctgtctatacataaaacagacgtgcacctgcccagggtgtgtctggtgggccctatcatatctctggatggggtatgatgtgacggaatcagaagaggttagaggaggacagtagagccttcccagaggccagccagaccacacacaatgagcactgaatgtgaagaatagaagagcccaggagggagggactgggaaacgaagactttctggaggagatggtgatgggggaagagggaggtgtgactgagggatgccaactgctggaccctctgctatgcctggcaggttcatgcaggagctgacggagatgctgggcttccgcccctaccgcttctatttctacatgtggaagttcgtgtctccactatgcatggctgtgctcaccacagccagcatcatccagctgggggtcacgcccccgggctacagcgcctggatcaaggaggaggtgaggggtggggccccaaaccccagggacatttgcatcttctcaggccttgaatgcaaccactgatagggatacacctttctagggcagctgctatgtgccaggccttgccaggtgcctcacacctaaaccgcaatcttacaacaagccaaagacagaggtggcatcatccctgtagcacaaacggggacaccgaggctcagaaagattaatgcacttatccagtctttctaacccatattctctctccatgcctgtggagtggaattagtccattttatagtaggagaaaccaccctagaccctttcaccaaggtgaccaggtaaacccccatccttggctgtgcctggccaggatggtgggaggggagaggagtggaaggccatgggtgagggcaggagagcagtcttggagggcctgggcggggagggctgtcacagtgccggcagcagcccttaaggcagcccacccgcaggctgccgagcgctacctgtatttccccaactgggccatggcactcctgatcaccctcatcgtcgtggcgacgctgcccatccctgtggtgttcgtcctgcggcacttccacctgctctctgatggctccaacaccctctccgtgtcctacaagaagggccgcatgatgaaggacatctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtgaccactgcccaagccctgcccgcctctccccccacgctcaacctgcccacttgtccaggcctggcctctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccactcatctagccctccaagagcctccgccaaattgtagccatgtaattggaacaacccataaggcctgcttcccagtccatgggagattccaagtggccactgcaggagtcactcacctccctctctccctgtaacttgccacctgcagttcttagggctgtggggtcagatggtggtggtgagaggccttggggctggggaaggagagtggactttggctcactctgccatgagaacaggacaccatcctgcccagcccagacggggttgctcctggtccaagaggctacctgctccaaggcggagggtgggagcaggtgtgccagggctcagggctcagacttgggagggcctaggcagaagccccaagttctgttttctgaggtatgtgctgcccttggcttcagcatgagccttggtagcagaaggtgaggaacctcctctgccctggtccctgggtggaatcttcccatgtccttggccctgcctggggtgtgtggtgtgtgctcctgcatcttgtctgggagtgcagtgaccgggaccagaaccttccccacctcaattagggcttagccatctccctgtccccagcacccctccccagcccacagtggtggcctctgcctctttcctggagagagaaggacagtgcacggagaggtttccagagcacaaattgttggttcctagcacaaattagatggtttggagcacaatggtgaagcacactcccctccctcctcacctggggtccaatgttctgtctagtggcagcttttcccctggaacaggggtccctggagttcacaggcttatccccaggaagcctcactcctggggaaagacagataatttcactgcccctttgagccaccactcactctccttattacacaagcacagccgcccagtgtgcacatcatgtgcagacaccttggaaacctttcccaagccttcctggcccacagtggccagtgccataggcagtgctgtggacagtagaggctgccaaaggcaagggctggtcttcaggatggaggccagcctgtgcagaaggctgcagctgacaacagcgaccccacctgccattaccttcagggcctcctctggaagagaacccattctcagagtgcagccagggaggaacctgacccaagagtaaatgtctgcagagagatggatggatggatggatagatggatggatgggttggggagtgggggtggatggatggatagatggatggatggatggatggatgggttggggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaacccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccagccccagaatcctggaggagcaggaggtagcaggagaggaccaggtccccaagtcccttcacagggtccccacccccactggctttggtgctgtccacacagtgcccaccagaaggcagagggaactccagggcagggatgtgcctgaaagagtcaacagtcccctgatcccctacctctgcctgccctccagccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttaccaaa

SEQ ID NO: 42 - DNA, 50892 bp, Homo sapiens
gaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtaagtagacttttctcattgctttttccttaaaactgtgttcccagcaaagtctgataaggcaagcgtcaggtttcatcttatccttggattgtttcccagagaccaggctctgttcaaactcagaaagtgaataatcaagttttgcaagttcctcttaatgaagacctaacgtgtcctaacaaaaatattttttggtcgctgtttttttaggggttgctttttatttgcttttgctgatgttatttatttacttactttacaactgccttgaattcagattccttttgacagccacaccagtccagaagaaaccacagctggcgctgtttatgtaccaagagctggcttcattcaatttaatcattatttgtttgcaagccaaaaaacagtcattttctgaattaagtagtcctttcacctttgtttatcaggaaattagaacaactatttgtaaacaaccttgaagcataaaagtgaatctaaatttggaattttaggatgattttctgatatatagatttagttgacgattaaaatcattggcacatgtgaccagttatgaaaaaaggtggggggtggctgatgcataatatcaagaaaagaaaatatactgttgacattgtttgaaaatagatggaaagagggtttgcaaagtgaaggggattcatcatgttacctaagagtctgattttctgtttctgtatctttttttccttctgtttcactctttctctgcctctaagcctctaagctgcttcttgcctttcctctctcgttttctttctcttccctacatttttttatttgagatagtgaaagtgggctgataagtaggtaaattttctttctgtcaagaatactcaaaaattatttttataatttgaaggaaagtcactgtttccttaaaaattaaagttcaggcttttttttttttcagcatgggatattcaaagctctttactttctacagaaaatatgatacccatgtgcttatttgaatcattattcttatagtccagtaaatccttactaggtcatgagtcaacaatgacagaaaacccagtgaaacaaactatcaatttatttacaaatgattcaccagctgtcagacttctgtgcagaaaaaaaatatataatactgtgtgccttctttagggaaacccatgtgagctaggcttgtacttctatcagtagttttcttgctaacatgtgcatgaggcaagtttagggactgtagaaattgtactgcatctgccgtgcttgtaatactgtaaacctgtgacaagctggttgagtggcagtcctctgagaaatccaagttactccaagctcactgtacatgatgtattccctcctccatgttttacccaagttagcccaggctaacttcctttgactaccaaattgttgtgggtttcctatattcagggactgcaagttaattctttcctgaggaaagccaaaatacaaagctagctctcttagaactaaaaaaattaacaaatattgcacaaagccagtgttaactattttttcctaccatgatttccttccattaatggtagatgaagggccatttaatacatctttcttggcccttataaaacaacgtccatctaagtacttaagccaataaacatcagtttcttatttttattgactaaagagaatatttgactataagtggttaatttatacaaatgagataactcttagaaaattattaggagaaccagaattgttttaaaagatgcccataactaaagtggtaatattaatgataataaccaatagtcaattgagtgcttactgcaagtacttactgcaattgagtgcttacaaggcactgttctgagtgttcaatatgaattgtatcacataagcctgtcaacaatcctctaaaataaggtcgttaaataaaatatgggatgaccatttgaatttgaacttcagataaatagcaaataattttttagtcccatgcaatatttgggcatcctgtatgtttatttgccaaatctggcaaccattctataaagttttgtaaaacttattattcctattttatagatgaagaaattgaggcacaaaaaggttaagcatcttgcccatggtcacacagatggaatggtggagacagaatttgaacccaggctctctgaccccggatgcctttccctttatcactagacatggtcttttcctgctgtgtgtatataacccagcacatggagctagtctgagatccccctgtaaggtttgctggattagcttgactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacgcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaaccagcttcaaagactatcacccatgcaatcttgtttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggttttttttttttttttgagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataatatgatattcttgatggaagcagcctccaaattctcagcacataatctatatactggaatgggtaacttccacattatggacatgaaggacctcctagctactagggaaggtggagctagaggatcacttgagcacagcagtgtgaggccacattgagctaggatcacaccattgcactccagcctggacaacagggaaaaaccctgtcgcttgggttggcttataaaaagaggtaccagaggctgggtgcagcaactcacacctgtaatcccagcactttggaaagccgaaacagaaggattgcttgaggccaggagtgcaagactccaggctggttaacatagtaagacctcatctctgcaaaaaagaaaaaaaaaaaagatggaccagataaaattccactgaaaagcaaaaatcaggtctcctgcctcagttcacaaacaaccttacatacaatctctctcccttgctgtatggctcctaatcactgtatccaaggaacagccaagctgtctggagaccacaggtttttcaaagacatttgccggaaacagcaccgtgcgctgagagttggtactgagccaggctcagttcagtttgcttacatgagcttctccccagatttatgccaatgcatttcacaaattttcagggtgcatttggccaagacatttcagccaaccaggttattcctgtgggtgcttctcagtatcctaaatgcaaaggaataattaattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataataaatcccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcacccagcaggaccttgacaaagcaggagtttgaacccaggtctaaccaactgaaaacccagaccttttctgatatatcacacatcttctacacaacataatacacagtttttacagcttcccttatttgcaggcctctgtgttcgtcccagtctctggatcaaagtcttattagacttgtcctgattgcttcacggggagtacagaacatattctcatgctgattcctttcaaggtcagccagctttccttctaacctctgaaatgacactcatttacattactcaattatttctgcccaaactattttatttttaattttctttaccaatggatttatttcttaggtcctaaaagaagaaaataaaatagacttctactcatagttatctttgtgcatcacgagattttcacaacttagagtataccctaataaaataataagaagaatttaatgtcaggagataaggttccttttaggacttccagaatcaccccaaagttttatgatgtgtctccaattccaaacctgaaaggagaacatgatggtttatgagacttcaatccagtctggaagcagactcactgttctagaagcaaaggcacaaatgaataggatagagactgctacaatttgaatgtttgtcccctccaaaactcatgttgaaacttaatcccaatgtaacagccttaagaggtggggcctttaagaggtgattgggccatgggggctctactctcctgatggattaatggattaacagattaatggattaataggttatcacagaagtgggtgagttatcatgtcagtgagtctatcataaaaaccattttggctctcagtgtgccccttcttgtcctgtcatgccttctgccatgttatgacacagcacaaggccctcaccagaagctgactagatgcagctgcctgatcttggacttcctaacctctagaattgtgagcaaaataaacctctttcctttataaatttcccagtctcaggtattctgttaaagcaacagaaaatgggctaagacagaggggaaagacaagaagatgaaagaaaggaaaaaaaaaaagcacacatagcacaccttgctgataaataaggatgatgatcaaaaaccctcatgaaatgagaagattggaaagaaatccataatgtacctggaagtactagacccaatccgagattcacctgttcatcagaacaggccttttttgcatattactatgttccaggcactgttttggggttatagcagtgcttgtgacagcaaggcttctgctttcaaggagtttctagggacagggagggagccagattttttttaattttagtaaaaacaaaaaataagaaaacatcaggaatatttatttgaaataaaacagtgagataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacctttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagattcagtggagcaggttcattcatgggggcaccaaaccaaaagtccttttaaaaacagttacctatgatttaaaagtgtgaagtgattgtagtatgatggggaaacagtgggccaactatcatgagaattaggagatctggacagctacatgatctctttgatcatatagttttcttacttgctcagtgcagcagtagtgccaacctgtcctcagacggggatgtaataattaaaagaggtagcaggggaaaattctacaaaccatggagggttgtgcaaatgtaaggaattattatttttttttatttttatttatttattttgagacggagtctcactctgtcaccaggctgaagtgcagtggcacgatctcggcttactgcaacctctgcctcccaggttcaagtgattctcctgcctcagtctcccgagtagctgggactacaggcatgcgccaccacacccagctaatttttgtatttttagtagagatggggtttcaccatgttggccaggatagtcttgatctcctgacctcatgatccgcctgcctcagcctcccaaagtgctgggattataggcatgagccactgtgcctggccaggaattgttattatcttggatgtctttctattacaattaccactactactgcaaaaatcctaattgctaataaagtatttttaggtttttaaaggatttcatagagtatgattgctggactgagcacagaggtaataattggtagagcagcagttaagaagattgctctaccacagaattaaaagaatgtcttcgcatagtccaagaactccagctgaattttgaaactccaaaagctcaaggaacaccagcttcacatttgcctgcgggaggggtgtgtgcacacattttgatttccagccctggaagtggagaatggtttattaagtgtttctccaggacatcccttccaaagggttgacagcatgtttgagcaactaccttggaaacacttaaaacctactgaaatgtaggggagtacaattatttctgaactatgggccagagtgagaaagtttgcccaagtctcatgattatgttccagttctctgctcttcaaaacactctgctaaggtgaccacacttgtttttctctctcaggccattctgtcatttagttgcataacctcagttctattctttcaataatatacatagttcacagtgccttcggggtagtttccgtatcaaggttttggtttcttctgatacaaaacacacacacacacacacacacaccccttccaatcctagaggaaaagagtatactaagtagagttaataaagaagcgttagatcccagaccattcagatttagctggtgggactgtgaggagtgtgatcatacagaaatgaacctctcacaggtggttaagtatgctggagttggaggcacagcctgtgtttgaatatcagctctaccacttcttacatgctgtgtgagtttagacaggtcacttaattaagctaaacttcctcatttgtgaaatggaaataataatagtaactgctttgtggaactgatgagaagattacatctatgagaagcacttagcacagtttccaggacaaagtgagtgttcaaaaaatgttaaggagttaccgttgtggttataggttggtgggaagcaatgtaaattattttattacaatgtctctcacctgacttctctttggctaactcagtggctctcaacttggggtgattttctgcccctatggcagaaaatgtgcctttttcagttgtcacagctggggaatgttactggcatccggtgggtaaaggctagggatgctgctagacattctacaatgcacaggacaacccccacaacaaagaattatctagcccaaaatgtcaacaatgctgaggttgagaagccctagaaactaaaacagtgtggggtttgtaatttattgaaaccatgtaacaactttagttattcaaagacacatttacctgggatataaaaactctaaaatgtacttcaattgtggaaagaggcatcaatgattaaccataatcatttctgatcatgaccaagtcacccctgagactagtaactgcaggtgctcacaaaaaaatatgcagctgtccttcctgccttcaggggatcattcatgaaagtaatttctcacctgaccaaaatgatcgcttaacatttattgcatcattgcccctgtttctgtagactactctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatacaaagattagctgggtgtggtggcgtgtgcctgtaatcccagcttctcgggaggctgaggcatgagaatcacttgaacctgggaggcagaggctacagcgagccaagatggtgccattgcactccagcctagatgacagagcaagactcagtctcgaaaaaaaaaaaaaagttatactagttgggcacggtggctcacacctgtaatcccagcactttggaaggccgaggcaagtggaccacctgaggtcaggagttcaagaccagcctggccaacatggtgaaactccatctctactaaaaataaaaaaattagctgggcgtggtggcaagcgcctgtagtcccagctactcaggcggctgaggcaggagaattgcttgaacctgggattcgccactgcactccagcctgggcaacagagcaagacactgtttcaaaaaaaaaaaagttataccactattactgtaatcattaagggaagaatacttctcatcagagtttgtctgcagtaaagtactcttgtcagctttgtgttcctttctgtcctatcttatgtacaaaccgatctccattatgtgtcacctgccttctaatggctgatcatcttgattcttacattacctgaaacacagtgaaagtgttagtgaacttagaatagtggttcttaactagagatttacccagggagattttttaaatcctgatgtcctggccacatcccagactaattaaataaaaatcactaaggttgaaagccagtcctcagaatcttttaaaactccttacgtgattacaatgggaagccaaagttaaaaccaatgagttagaaaaaaaaaaactattataatgagcagaagcaaaacacccaagtgacgtttgtaacatcactctctcacatctactttcaggtgtttcggcatggagaccgaagtcccattgacacctttcccactgaccccataaaggaatcctcatggccacaaggatttggccaactcacccaggttggttggacttttagctaaagattgttgatgaagctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgaggtaggagaatcgcttgaacctgggaagtggaggttgcagtgagccaagatcgcaccattgcactccagcctgggcaacaagagtaaaactctatctcaaaaaaaaaaaaaaaaaaaaaaagattcttgatgagtctcaaggggaaatgtatatagaattgtctgttttgatattttttgcccttctggctttatttaaatgtaagagatgtacatgaacaaagactatatgagcttagaaatgctgaagagagccaagtggtaatcataagccaggatttgaatttcttaggcttcacatgagaaagtgaaaaatagtcttgtaatcaataagctgaatcaacagcattgggaaacatgattccccaaagtgctgatatcagaatatgatttcttgtcagctggatatattgggatttgaccttccttataagtggtcagttaaacacagggagccctactttctgaagagcatctaaggagaaggtgaactggggagcaaagccatctttagtcactgttccaaagccctattccctttgcttgtaagattggatgactcttctgtttggagccacaaggccaggtgaattgcttctgtcctgatctgtttaaatatattaattaagaaaatgtcacagaatctttagagtagaatgtctcaaaaactaatgggtcttaatcctgccaaaacattgggattatctggagaggtttaaaaaatatattgatgtctgcctgggaggttcttatttaattggtctagtatgtgtcctgggcattgggatttttagaagctccttggtgatcagttcactctaatgtgtagccgaggctgagaatttctgccctgactatatttcatagaggagaaaactcaggcaggctatttgagaccagcatcttctgtctcccaggtcaaagctcttctcaccatagcctacccatcttctgtccctttgaatgaaagagaggctacaaaaattcagatttgcttgttaatacctatggctctgtatagactcctgttctgttgctatgttttcccattaagaccaaaagattcttctaggctgcaggatctgagttcttcttctgaagaaccttgattacccatcagattctattagggcagtatttctcaagcttccatgtgcaaatgaatcacttgggaatcttgtcaaaatgtagattctaattcagcaggtctgatgtgggacctgcgattctgcatgtctaacatactcccaaggatgacaatggcactggtacatggaccacatttgaagtgacaaggttctagggctcagattcctacccttgtctaggtacttttttttttttttttttttttgagatggagtctcactctgtccccgcaggctggagtgcagtggctcgatctcagctcactgcagcctctgcctcccagattcaagcaattctcgtgcctcagcctcccaagtagctggaactacaggagagcaccaccacgcctggctaattttttatatttttagtagagatggggtttcgccatgttgccaaggctggtctcaaactcctgagctcaggcaatccacccgccttggcctcccaaagtgctagaatttcaggcctgagccaccacacccagccttgtctaggtactttaaatctacataatcataagatgatggctgtctagatcagtgtctaggtacttttaatctgccttgtctaggtatttttaatctgcataatcataagatgatggctgtctagatcagtggtttttaaagtgtggtccctggaccagcagcatcaccatcacgtgggaacttctcagtaatgtaaattcttcacgcaatacccagtgaaccataaactttggaattaaagcccagaagtctgtgttttattgagtcctccaggtgattctgtgcatgctaaagtgtgaaaatcactgcttcatacagacgactatttaaaaagtcagctgtaagaacacaattagacctaaagtacctgcttctccgctactcaggtcacggtatattattcctttcccaccttgtccctatcgtagatgggaagtgattatagtggtggtcaagcaaatgacaagtgtgacaagcaaatgacaagtgggaccaagcagcagccaccgtaacaacctcctctctggctcccaaagctctagtaaggctctggattaaagacaaacttgaatgctgcatttccaaagcatggtgctctactacatgcatctgaatcacttgggagacttgttaaaatgcagatgtcagggccccactcaggaactaatgagctggaatctctgatggagatgctgaggaatctgcatttcaacatgcaccgctggataattttgtttctgatgcacggtaatggttgtggaccactgagctaatgcagtgcatctcagtgattactgtccatcagaagcttgttaaaaaatattcttgagcaccacccccaaaggttctggttcagtaggtcaagggtggggcccaagaatttgatttctataatgcttttaagtgaagccaatacagaccacacttagagtaacatgttctaatttttttatgaaccaggaattaataaactgggcagatagtaaagcattgcccacagaggttgaaagagactttcagattcatcgagtctaatctcatcagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcagggaactgtaactaaagagtacagctcttttgttttcacttaaatatgtgtcattattgtggaactattaaaccacaccattgttcattctacacacataatgaaaaaaaaaatcaacaaatttttatgatagtgtgattcatagaacttactttcattaatttttgcttttatttttttcccatagctgggcatggagcagcattatgaacttggagagtatataagaaagagatatagaaaattcttgaatgagtcctataaacatgaacaggcaagttggggagccaagagtgggaactttgatctttgaaataattaaaataattctgcatatataaaagtgctttgcctgttttccaaggaacttatacaagtcagaggtcttgtttacaaatatattcctctttatgcaaatttttgttccaaaaagtttgtgaatatgagtaatttcaagattttatgaacacctgaataaatactttggcttgacaagtagccactgcttaattgatctcatttgtcaattcaactattggccaaccaggttgctttgtaccatgatcataatattgctcattccttaacaagtattatgattctgatgttagcacaatgtctgtaatatttcactgtgggtgtcctttcctttctctaataccttggcagctctgtagaaaaaaacctcatgctccctttacgttcgcttctgctttgattttcctactctaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggtcagtatactgggaaaaccaggagatttcagatggacctagaatgaggaaggcaggctactcaacagttgtggatttgggagtctggacactccttgagctgtgcagttttaattctttcttaaataaagatacaaaggacaatttaggacatggaaaaccctagctaagagagagtaggaaccaaatttctctttggatctgtatgatccactttgttttgccactcttgcaactcttggcaatttgccccctcatcgtcatacacagagagagagagagagggagagggagatagacaagtcccccagtgttctgccttaattcccaggcttttggtgccccaaacaggtttctccactctccagattatccaaagatatttataccaccaaacactcctccactcatgaaaatccacattcctaggtagagaaaaaaagatttgagtgcataatcattgcctaacattttatgtgaatcattgtgttacctttcataacaactctgaatggacaatattcttgctctccttttatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccaagatcgcaccgttgcactccagcttgggcaacaagagcgaaattccgtctcaaaaataaataaaaaacaaaacaaaacaaagactggatagcagcaccaaaatttagcaaaatgtagaccacaacagctatttaacaattaatcctgaatgatagtaattaagttacacagaaagagaatgcaggtgctagtagaagaggaggaaagaaacagggagagtgagggagagaaagagagaagcaaggaacattatctacctatggcttccatctatctgattcactaaggtcaaaaaaattctctcatatcaactaagaaatctaatgaaaccaatcaacactagcttattcctagcatttagctgtgctgaatgctgtagagaaataggaggcgaagtttttctaatttatagtttgatgaaagcaaattagcatgtgtgaaatgtgtagaagacattataagatggcgggcaataatttcaagtacaagccacatatgctgggtgaagtcagagaatgagacttacgtgcagttaccacagggccgtcgttcaggtcttcataaagagagtgagaacttgaaccagacctcagaggagagggaggaaggagaggaaggcagcacaaaaacacgaccatgagtgaatatgtagaatgccagttcttctgtgcccagagttcatatttagaaagagaatgaaaataaaattgattatattggacacagattagataatccaaatttaatagccaggaggaatcttgagttgaaagaaaggcagtgtgatgttagaaggagggctgaatttgaagttggaaaacctacatccaactaccacttcagatatatgaccttgagtaacctccgtaaacctcagtttcctttctgtaacatgggaaaatagcacccacctaacttcttcttagggatttgtgaaagtcaagttagttaaaaaatggaaaacaccataaactgcaaaattctggacagatgtctcggtgattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacacaaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttataggaaatagatgataaagaagtaaaataaaataatgtcagatggcgatgagttcctggaaagaaatgaaacaggttaatatgatagagactggcccaggatggctagaagaggggtagaagtcaatgggggagtgttcaaggcaggaaacagttttaggcagagctcctaagccagtgccttccgggacagcaagaaggcccaaagtgttgctggagaggagtgacaagggacagtaataggaaaagagggcagtgcagttcctagaggccaactcatgcaaactcttgatgtagtctgtgtggtggtgagttttgattttattttaggtaaaatggaaagccaatgaaggtcatgaaccacaaaatgacatgatctgatcgatactttaaaaagattcatgcttaaaaaataataataggccgggcgcggtggctcacgcctgtaatcccagcactttgggaggccaaggcaggtggatcacgaggtcaggagatcgagaccatcctggctaacacagtgaaaccccgtctctactaaaagtacaaaaaattagccaggcgtggtggcaggcgcctgtagtcccagctactcaggagagtgaggaaggagaatggcgtgaacctgggaagcagagcttgcaatgagccgagatcgcgccactgcactccagcctgggtgacagagcaagactctgtctcaaaacataataataataataaaaggtattagtgtaactgctgtgtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccactagcaaaagcagagaaaattacaaagagggaatggttaaaaatgaagttgaattcattttaatatgatagaggctggggaaggatggctagaagagaagtagaagtcagttggggagtgttcaaggcagggaacagttttatgcagagatcctaagcctatgccttcagggacagcaagaaggcccttgtaacatgtacaagtttagccttgtacatgttaaatttgagggaaaaaaaatgcaaattagttatttctaccaagggctagaaatacaggactagtcacagatggaaagtaagggcaacaaaataaacttgagagccacaaacctgtgggttacagttaaaattataaaacactgtcaaaatttaattaattttaggaagttcactttgtcctcacaacaggtttttgaagtatatttttctaagtatttaatacgtactcttaacagtctgcaaatttgcaaaacctgaagttaatgagtggttaattgacttaagattttttccagaatcaaattcctttctccatacatacatgcgttggggtgtgtgtgtgtgtgtgtgtgtgtgtgtgtgtgtgtacaggtgtgcacctactgcaagaaatgaaagtgattgggaaggaagcaagataacagttattcacgtggaagatcgagaagtgtaaatatttaccaccaacagctcagttatattatggcaagtttatgaatgaaaaaaaaggattttcaattctgaatacatatcctactattttaagacctatagatcatttgattctttctccccaattttggaatttccactcagctcaaaacacatttgaatcttttattaaggttgctttgaacctaatgaggcttaaaatattgctgcagcatatttagcaaagtttttctgactcataacagttttatgatttttctcttatcctcagttgctatacctgcctttcaggaactgccctcgttttcaagaacttgagagtgagactttgaaatcagaggaattccagaagaggctgcacccttataaggttaaaagctagttttgtttagtggtacttgttagtttgttagtggtacttgagtgtgagggccaagacacaagatgaagctttggcttcttaaaaagatgggacgaatgcatctgtcagtggctggttacagcaatgggttagaatatttaatgagggaggtcatcactcctgcttcccttccccatacaggggtcacaagccaatagacaagccagtccttttgaatcctttactcatggccttgagaggaaccaggtgtgagtaaatggctggatgagaataaatataagtctaaaatcacctgccttattcaggctaaggggctgggattattgtcttcatatacaaaggatagtcttttttttttgtttctattttgcaaagtacccattttcagcacaatacaaaaggtagatataatgctgtgtactttttaaaataatcttttgaatattatacattcatactgtccaaaaattagaaaatataaaaaggaatacagtggaagcctccatgaccccacaggtaaccactagcattattttctagtagtcttttatgtgtttattttatgcagtcttttatgtattttatgtagtattttatgcagtcttccaatttccttatgcatatacaaacataaaaatatattctgatagtttcttcttttgttacacgaaaatggtatactattcatagggttgggcaccttggttttgttttgtttttttttttccatttaagaaaatatattggaaatatttctatatctgtatgtaaagagtttcctccttttctttcttttccttttttttaacaaatgtgtaatatttatatttatgccataatttatttaaccagcccctattgataggaatatgggtcatttttcaatctttcatttttacaaacagcatgtatgaataacttgtgcatctaaatagtttcacaagaatacctgtgggataatatcctagaagtagacattctgggttaatctgaaatattattaatttaccctccaaagaggttttactactttctacttctatcagcactgcatgcaaatgcccatttctccacaactttgccaacagtatgtggaccactctggggatatttgccaatctggtaagtggaaaataatatcactagaagcatccatctcctctaaaattaggaataagacaaggaagctcactattataactactgtacaacatcgtgctatagtacttttcttcttgtgatgagtgagtttgggtatcttcatctagttaaataccattttttggtttgttttttgatattgtatttcttttttaacttttattttaagttcaggggtacaaatgcaggtttgttatataggtaaacatgtgtcatgggggtttgttgtacagattatttcatcacccaggtataaagcctagtactcattggttatttttcctgaccctttgcctcctcccacccttcaccttccaagaggccccagtgtgtcttcttcccctctatgtgtccgtgtattctcatcagttaaatgccatttatatttccttttatatcaatatcccttgactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataaggaaaaggtcaaggagcttgcctgccttcttcaggaccaccacattccaggaacctctaagtgttcagctctctgaaggctctctgaaccctctccctttgggctttttatggagatttcattgcataggcatgattgattaagccacaggctattggctatcaacttaaattttaactccctcccctccccagaggttctgaagtagggctgaaagtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaaaaaaaagaccaaatatatatttcacaatatcatagataatgaatggcatttttaaaaaaaagtttgtctattaactgcttaccgtgttcttgccatgtaggttctgtatcaatgtattcttatatggcttctatattttgagtcatgtttagaaaagctttccccactcctaggttataaaggaagtctgcaatgctttcttctaattccactctagcttcatttctcatttatatattgaattcatttacagttcatactggtagaaggtatcctgtttaagttttttcctggaagattatctaattgctccatcattgtttattgaatagttcatttttttcctacttattgaagctattatatattaaaattcccataggtgtggggtctatttatgtaatttttattctgtttaattttttattagccaaaacttgggttttaactattaagactttataatatgctttaatatctaaagggctagtcatccctcattgctttttctgagtttccatggctatgttttaattttctttgtgaacttcagagtcagcttgtctagttccaaaagtattttttaatttttagtattttcattaggatcatattaaatttatttaacttagggagaatttgcaacttttcactgtcaaatcttcctaagaatatggtacatgttcctacttgttttatcttaaagattattttagggttttcttcatatatgtctttacattttttgttaagtttgtttcaggtttacagtatctccagttttcaaaaatgtgtatctctgatttcttccttttgcctatttgcactggccactacttacagtataatgttatgggcagtgttggtagcgggtattcttgtcttatttctgattttagaggagttttcctaataagcatacaggcttttgaaccaaaatagacatatttttatgaaattaaggaaatatccacctttcttattttcttgagtgtatttttttaaatcaatattagttgtttaatctcctgaatgattgttttaacattttttaatacaatcaaattatttttctccttggattaattacaatgattgattacattcatagatttaccaatgttgaacaatctttatatttctcaaatcaaacccatttccttttatgtgacattgaattacttcctgttattttacttacaccttttgcattgatatttacaagtggcattgaactaatagttttattttgggggcaatctttgtcagtatcagtgttacacttaattcataagaagtttttgaaagttttctttcatcttctatgctccagaacagttaaaatagcattagaataatttactcttgaaaagcttggtagaattcctctatgacagtcatctggccctggagcttttatgtttgagaagatggcagtaggagctctttaacaataatttctattattttatgaaaatctattgaggttaatattggcaaattgtagttccctagaaatttcatccatcagacagacaatatcttccaaaaaggcttcccagaaatggctgccaatttcagcagtcagatagctgaacattgggtctcattattgcgacattccaagaaacatacagaacctagcgaaagatttgcattccatccaagttttatatgtatagccaaagaccaagccctatttgtgttgcatgttccaggatgctttggcctgaaatatgctttcctttctcacctgggacatatttacacatgagttatactttacccacttctaaaaagaatctgaggcagtacacttcaatccaattccagcacgaaccaggaacatgtggcagtcagccagcatctatctacattttaaatgtaataataaggaataatcaattcgtgtttgtaaaattctttggaatgacattatcgtaaccaatattactggtgcatttttctgtgaagaacagcggttctcaacaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaattgtctggcccaaaatatcaataatgctgaagctgagaaacctgtgtaggaatttttctttctctgtttgtgtttcaggattttatagctaccttgggaaaactttcaggattacatggccaggacctttttggaatttggagtaaagtctacgaccctttatattgtgaggtaaaagaaaaaaaaatcacaggttaacttgcaatctgattttatgatttatgcttattttgaaatagatgaatatcttttctttcacttctttatgaatgtattacttatacttcttttgacattgaaacgtaattcacaacttccttatattaacttgaaaatgctgacttctcttttctctctattattatttatgttttcaccctttagaaaattacaagcaaaattgcttttcttctatgagtttccactttagttttttccccccttggattcagtaggagcttatttattttgcagccactcaaaaatgctgggttcctgtccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctgcctttgaaactgggggactcctaatcaactcttcctaacgggtaataaatattggcacaaggtctcacctgccctgcttgtacttaaccattcatttaacgcatatttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgagctgtgatggccactgcattccagccttggtgacagagcaagacaatgtctctgaaaaaaaaaaaagaaaaaaaaagtcagcaaactagaccttgatgggggtaggggagaatatattactgaaggctccagaaatatattgcctttcctaactggcctctcaggcagcccattcagcttttaaggaaatatcatttaactctgtcaggttcatagaaagatttctaaccctttcataaaggaatgaggtattatttccctactgcacccttactctgcaaaatatgagccacccactgatccagagttaaaccaaaagctatggactgggtaggaatgggtaaattcatttatataagcttttcttctgaaagtcaataccactacttatcacaatatgaagttcttttagaaagaaatggcaggacaagaaagtctggccctactagttcttgtgaggtgaaaaaggataagtcaacaaagaggacagtcatataaatacacatacatttttcttcctttttctttgctacagagtgttcacaatttcactttaccctcctgggccactgaggacaccatgactaagttgagagaattgtcagaattgtccctcctgtccctctatggaattcacaagcagaaagagaaatctaggctccaagggggtaagtattaaaaaatgagaggagcatattggatttgtggttgaatgatccaggtctgagtcattccctccactaatcaactgtgtgatctcagacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgtcatatgttagtataatcataactattactcactcaagcccttagttttctatctggaaaatgaaagctaaagctaaatgatcctttccatcccctccagatcaaaaatcaaggatctgtgtctgagccacatgaaaatcaattgtgtcttgtggcctatatgatgaatttttcaagtgggaggtatgacaaaagtggcctgttttcctgaaaccctgagtggtagtcattgtgaaagccgataaaatatatttttcaggctaattgttatatttttcagaccaattatgtgctgttaaaatatgttgcaattgacaagtttataacacagcttgaaatttttcattgacattgaaagctgttgagatttatttatcagtgatgcctcttcttggttagaactggctcttcgtagcacaggacaccctgtcatatgaaggcagacccaggcaagaggatgctggattcttgtaatcaggataagtggatggaagaaaaaagtcaggaccagcaaagacaaggacagatgttggggcttatgagagaaactggatgggcaggccaagataccaaatgaggtgtcagacttagatgtggttatcataggtattaaaactagggataaagaagaagagaaagttcatcatgtcaggttgacgtaatgaggaaagtccaagccacaggagatggtccaagtcaggctgacacacatattcaaggcattttgagattaatacaatcacatcatgattccagccattgacagacactattcaccacagcatcaggacaagtccatcaaaatcccaagagaatgcatagaggcaaagcatattagggctggaccagactgggaggttgttcactgaggctacttaactagggaaaaaattcaaatcactgaccagaaaaggaatcaattatagctagaaaagcagggctgcacaccaggtataaagagtgaggcaagctgtaaccaggggaatgaggtatgaaaccaggatggtcaggagcaaattcatgtgagatgaataaagtaggttggggcaaaaaatttaggacagtggccattaacgacatgaggttgttgtagatctgctattacaaaaatcctgattgcatggcacagagacagacttgatagaaatgtgcaagtccttacttcacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagttgcaagccccatcaaatggtggaagcgggactcttgatttatttcccccaacctagttatggtggattcaggcacctagtccctcacaactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagtttatgtcttcaggtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcctcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggataaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagtttaaaaaaaaaaaagtatgtaaatcacattacctagcacagagcagatgctcaataaaattagatctttgcccctcttcttaagtcatggcagggagagtccgcaactatgaagtgacaaaaagctaatgaactaaaatagaagcttatgtttggttcagtttggttattgattcatcttctttaaggtgtcctggtcaatgaaatcctcaatcacatgaagagagcaactcagataccaagctacaaaaaactcatcatgtattctgcggtaagtattttcatcttcatttaacatatgtttgttcaagtgtgtgatctcttgaagcacaggacctcatctttttttaatcttcatttccccatctccttgtacgtggtaggcacttgcacaaagcttttagaattaaatgcatcattctgtcctttaagggatttataatctaaactaacaagaagacaaacataaacactatacaaaatgggatggaaataccatgcaggcaagtgctatggcacctcagaaaatctagccatcccttctgttccaagagggtggagaagagaagcagaaaggcttcctagacaaggcagcacatccaacacatcaaaatgaaaggggttagtaagtgctcctcactagtgtgtaggacaaataaagtaaattattaggacagaagtggaaggccaggaatgttgtgtccaaaaagtggtaccaaattagtggatgttaactgtgctgctcaatatggaacctagtagccagaagtagctacttacatttaaattaattatgattaagtagaatgaaaaattaagtccctcggttgtattagccacatttcaggtgttcaatagccatatatagccagtggctactgaattggagagcacagatatacaacatctccatcatcatggaaggttttttagatagccctgatatggagtgtcagaagtttatgctggatggcagctgaagggccatgttgtcctgctgcttctttgtttaattgtagaaagaagcaaggaagcaagggagaacccccctgtcagtgtttgctcagggaaggcagggcaggagtgacaggataggagcagcattttggaaattaattattttatagaataactggatgttgggaacaggatatggtgtagaaagcttttgtgatagtctagaaaaatggggatatggcctaaaattagggcagcggcaggagaggaaaagaagtgagccaggttacaagaaaagctgagtgtgcattctcagtgatgaattggaagtgggtggaagacaatgatgtggaaggtgaagccccagatgaagtcaagatttcagttttcagtggcaggaaggaggtggtcttgggccaggcaaatgtactgattaggcaatgggtttgaaatgccacaggggcatcccagcagaaaacttcagatggcaaagagaatagaaggaggaaagggaagaaggactgcaactcaaagttggagctacatttgggagtagaaagaaaagagagcaagagatcttagaaaaggctttcatcttggagaagccagggagagaagagtctgagacgccaaggagagacacagtgtttggggaaaattctgcaattgtattatacattcaaatagctgcccatggagtctgggatgagcagggaaacaggacatagcatgctgactcctttcactcacatctccatgacaaaaggtttctcagctgtggctggagaaagaaagtcatgttttcattcatgcaagaaggtgaaagaggtgactgaagatgccaggaagtttgtttattatcaggagccctaaatggtatagactagggaaataggcctgggcaggagcagagtgcttcctggagagagataggcctgaaattagtcatttctgccaattttcgtagtgtctaatctgatttctagttttaacttgtggtgtgacttccagcatgtcatatccgtagctcctttttttttttctctattagattacttctaacgccttttgaatatgtgcacgctgccatacagtttaggcagccaaatgttatcccaattttgcagatatggaagttgaggactgcctaagattagatagctaatcagtggcagaaagggggttgaaaaccactcccctataccttccagccactctggggtaaacatttagctttacaattattttaaattgcatcctatacttccttgtattttatcttccctaaacatttaaacctcatatattcttccacaactttaaatcacagatgatgctaatctatagaaaaatataatctagcattaatgtgtttcaaaatatttcaaaaaggcacagcacttaaggaggcttgattcaaatttactttcttccatttggggttatatgacattaagcaagttgcttaatttccctgggtctcaatttcttcatcttttattattatttttaaaattattttattttatcgagatggagtcccgctctgtcaccttctgagtgcagtggcacgatcttggctcactgcaacctctgcctcccgggttcaagcgattctcctgcctcagcctcccaagtagctggatttacaggcccatgccaccacacccagcttttttttttttttttagtagggatggggtttcaccatgttggtcatgctggtctcgaactcctgacctcaagtgatccacctgcctcgggctcccaaagtgctgggattacaggcatgagctaccacgcccagccaatttcttcatcttttaaatgaaaataatgatacatatctaaatcatactgcctagcacaccgctaatgctcaaccaaaatctttccttctctacttattaagtcattgtgggcgtatgggaaatttaattgaatcagaagccatcatggtgctgtacaagtgcttcatacctattgaatgtgaatctgaacaggcgataaaattgatttcaatctctgtagcatgacactactgtgagtggcctacagatggcgctagatgtttacaacggactccttcctccctatgcttcttgccacttgacggaattgtactttgagaaggggtaagtgactaagtgcttttcaaaatcagtatcactggaccttgggtttcattattattattttgggttaagggttgtgtgcctgtttgtctttgatttggttttatattcagagggaagaatggtggtaacaagatctttgctagtcatgtctcttttttctttttcatgaagacttttactggaaaataatatacacagtagatgaaaaaattgggaaatagcctatgtaacagaaattacatttttaaaaaaattaaggtattctaagaagtaggcatgtattgtatatatacttggcaagagaaaaatttcttgatggttatataataatattttttcaattaaagaattcaaacatattcattcagcttctgatgattcatatccacaagtcaagattcttaaagtacaatttctaactggtgtctacctctgtgtgacctggtgtggccctccccagatgaccacagcttagcttgaacccattagaagggtcaaagttagcgtagccaaatgtcccagttcaccagaattgacccatgaaatctggtgttctcagaacatgtgaatttcattgttaaaaccagaaatgtcctggaaaaactggggaagaattgattatcacaccaaggtcataccaaaaatatttatctgctgtgacaacgacattctcattgggaggagaagaaggaggtatttggaacaagtcaccagacttcatgggatattattagtgaaataagagcaaggaaagggctgagttaaggcagtgaccccagagtttgttttgggattagtcagggagatctattttgcccttccctcaaggcattcacaatagctgcacaccaacctgactgtgcagttacatggggacctggctcaaaagagcccatgcttgttttaatgatctgctgtggccatctttaaattgtaataatgtttaaacaatgggccctgtatttcatcttgcaaattttgtagtcttggatgtagctttctggcccctgaatttgtagagtaagaaagtaacagcacagagacttcattctcaaccaatatcttcactgcttacaaagaagtgagttctgcacagttagggacaggtagatacattctttattgaacctctaactgagtgtcaggcacaatgaactagaactaaaatgtggtcttagttaaccttgctctcaaatatctagagtcagcatggagaggtaagacccacaaaatggagactggccaaatagaacagaaaatgggaatgaaacgactagagacataaaaccctctcttaataacaagcccggcacaagtctgcccatcagaaggccagctctgggcacagagttaataaatccaaccaaattccaggatcagcttcaggagcaggcaccatctcctttgggataagacaagagaagctactgactctactcgtacctccctgttctctggtttctggaccccagtggtccagagcttgctttctcagtgcacagaagcattttctcccactgaattgccttgttttacgaccctgagttaaatctatattacaaatcaagtgtggagtattttttcaactgaaaggcagtgacatacagaaaaaattaaccaagggccacgtaaaggtcaagtccaatttgttgttgtattaggattttttttattggcactccagggaaatatcaaaggtgaaacgtgattgcttttaaattaggatcaaggaggcttcgagttaacgaattctgtctaagcctgcttattaggtgatcctgactgtgaagtgatctcacattttcttatgagaagatacggagagagacagaaagagagagtattttagattttcaaccatcttaaatacgtaaacttttcaggttgtagaaaaggtagctaaaaatattcttaaaagatttaattttgggttagatacagagatttaaaatcatagactatataaaataattcattaagttaatattgctttgtttcacttttacattttataaaatgattttatctaaactctttgtactcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggaggcagcaacccgcttatcaaccacgtcagccttttaaaggggacacatatcatttctgctcactttctactggctaaattagtgacttggtcctacctaggtacaacgtagtcttggcaatgtggtcacttctgagccataattcaattctatggaaagagaataacagagtttgatggagtattggtcatctaggccatatcatcttaagacagaagatgctgttactgaaaaagttattccaagatataagtacccattcataatacatattagggaggtttttgtaagttttatagacatcttattttattttatcttattttattttattttattttatttttattttattttattttatttttgagatggagtctcgctctgttgcccaggctagagtgtagtggcgtgatctcggctaactgcaacctccacctcccaggttcaagtgattctcccgccccagcctcccaaatagctgggactataggcatgtgccaccacacccagctaatttttgtatttttagtagagacggggtttcaccgtgttagccaggatggtctcgatctcctgacctcgtgatccacccgcctcgacctcccaaagtgctgggattacaggcgtgagccactgcgcccagccttatagacataagtgaatatttgctgttactatgtttatatggctttttaaagtgatgttttaaaaggcttgtttataatgacaaccaaaagtagccattgtaaggttacaccaaaagaaggatctctaaatccttcttgagttcccctcctgactccttgattagcaaatggcttccataagcaactcacgctggtttaactcaggttagtttacaccattggaccttcccaaatagtacattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagaggggagatacattcagaaagaggactgaaagaaatactcaagtaggaaaacagaaaaagaaaaaaaggagcaaatgagaagcctaaaaagaagggaggaggagaaggaaaacccaacacccccacctgcctcccacttcttatccaaaggctcaaagtcccacccagctccctgcaaccatcacttctcaccacctcctctgatttagcatcctggtgcctacctcctatgtccctgttcatctaacaaaccagccctcccatttccaccctgcaaatctctcccgcctgccccagtctccccatttacacacctaaattggctaaaatctccccataagtttttccattagtccctcaactggcatgtaatagtccaagtggaaagaaattcagtggcagttcaacaacacagaactaacagagctctctcctctgcctttgtctgccagggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctaggatgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctccctttgtgtttggggtttttgttttagtataacaagatggaaaatattaatataaagtaaaatgatttgactggcttaaatgaacattttacattgaaaatatagtttggactttaccacttcagataaaggtgaagctgtggatggctctgcctcatctatttaagatggaatttgctaaggaaacaccctcaggaagtgcacaatatactagggaagtaaagagatacatactgtacaacatggaaaaaccagggctatgtcttatgactacacagattactgtgggaacaagagttatccagatttggagtaggggaagtaaggaaggtcaggaaaggctttctgcagaaggtagcaactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttgcagtgagccgagatcgcgccactgcactccagcctgggcaacagagcgagactctgtctaaataaataaataaataaataaataaatttgttaccttttcccctgaccctactcttgtctatcttgatgagcagcaatacctggtaacttaggagttattttttaccctaccctctccttcattctccatagtctctcacctcctcttgtaaatctacctgtggtatgtttgcagaattctttccctcaaaacacaaataacaatatgcaggtagagtgaaatatgattaagcagcaaaaaatgttaatagaaagaaaaatgtaagggttgatgtgctgcagcccgctcatacagatctcaagagtggaatgtgtccatcagttcccaactctcagttcaaccacttcacctgggcagctccaatgtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatctagcaaataaaagtacaggatgccgagataaatttgacaaaaggctgtaactgccaagtttttgtaattcattggaaaaaaaaaaaaaaacaatacaggacacttaggatgttctgaaaaagccgatacaggaagcaggacaaaatcattaaatataggatatgtcctatatatgcaagatactttgcaaccctactccttagagtaggggtttccacccattaaattctatccataactataagcagtgtttttagctagtgccagtaggctcacttaaccagattccagatcgtatcaattaaattcaccagagtctttgctggaaaattcacaagtctaaggccatagcacattgcttgaaaataataaaatttgtcaaactgcttctttaattccaacattttactaacacattcagactttcttcactagtgctctcccacccccatctcaatgtccaactctaattatttcacaagaaggagacttactagtgagaagtcccagttttctctcattatctttctaaagctgagaatctacagcacaaatacacatgcccaagattcaaccttgagcttcttaaaggcaggatccatacatgtttcctctttgagtgttcagccagtagacaacgcctagaaccttgtgccttcaatcaatatttgctaactgaatacatgtccagccctgcatacctagcatggcttccttgtggctgagctcagaagtcagaagcctggaactcagtttatttataaataagagagagaagctatgaatgagcctcaaaagtgattatactgtagagacccaatcattggccataaacacatttctatgtgccaacatgtctgtagtatttgacttctgttttcagcatagttgttttggcattctcatgttcctccattgctattaaaagcccttgttcaatgatatcccttgttcagtgatatcccttgttcaatgatatcccttgttcaatgatatccagcaccgctcctccctcaaagatgaggccatctgattaaaataactgtttcctcattcttgttgccattatcttcagtttcttggaatatatctcaccatttgctaaagacattggcaacttgctttggtatgctccgattcactcctcactccactcctgccctaaacctaggcaattctgacagctataacgctgacctgtcccatacactgctcaccatgccaatacctaagcctctagatcaagtcagtcacatggttttttcattctgatctgtgagtagagctgaagcaagcaaaagtccaagcctattgtcaccatttcaaacgatgaatgtagacattttattccatcctcaactgagtctctcagtgtttcttggtaaatgtattcacccctactgaacacttttcctactccctgcaggaaggcctgtttgtcccaaaagtctgactccattttgttttctttattcttataagcaagataatctattgataagtcctttaagttctactctcacaatctcaaaaatatctcagtagctttaaccttcctttgctgctgtccctcaggaaaccacattcctccctgcatgggctgacctcattgtgagtgtgaacccatctccgcagtctcctcaggaccccagggaatctcttggctaacttcactttcttcctctgccctggctccttcccttatactacgaaaatgcccaaatatcctctcatcaaaacaccatcaagtgcttattccacctcactctcttcaatctcaattttcttgaactaatgattcacatgttcttgtactattttctcacatccatcttatgctttaactattctgtaaaattatgtccacccttctgtcatctcttttttttttaacttctcttttgaaagccatcagtgtctaattcagtggcctttctttcattgtgaagcagctattagtatccccaatttacagagaagaaaactgaacctcagaggataacatgccacaagtaataggatcaggattcaagcctaacactttccaacatcctatttctaccatatcatactcacttttcattccactgtgtcttgtggactactttcttagaccaatttccaaaaataggattggtgggtcaagataaatgattatttaataagcaatagatttactgagtacctcttatgtactcaatattttcctatgtatcaagcattaagcttgctgagtaaacagcagcagacaagaagactgtccccatatggcttgcagaccttatggagaggaggggtggacgaggaaatgaataattaaatcagccctaacagcaaagtatggtgaattctgcgatgaagggcataaggagaaaacacagcagaggcaattagcctaatgggtcagagaaggcttcttggaggagtgatgttcaaactgaaacctgaaggagaaatggtactaagcaggtgaatgaaggtgaggagagaggaggatgttacagacaaaagaggagaatgcataaaggccaagaggccaaaggcagcatagagcactttgggaactggaaaaagtctagtgaatgtgtggagagctgaggctgcagaggcaagcactaagtgctccataggtcaagttgagctgttgtgctcatggaaaggttttaggcagaggacagatgctgtaactggcttcttgttttaggaagacccttttcagtcattacctgtacgagatctctttgtattaagatacaattaatcatgctctcttttctcagtgtctaggacaatgctctggcaaactcctgaaatattttacagtacaaaggagcatatcatttaaaaataaataaataaataaataaataaatatcacagggagagaaagcatacgcgctcacctgagtcttttctttgttttcaggttcctcattccacattcagtattagccagtatacccaggcctctgtcttctatgtctacaatccttatttctacatctaactgtagaattcttgacctgttttgtcaagctgcctactgatagtctctatcaggataataacctgtctcaatcccacactggagacaaaataaattatcttctctactccaaaccaattcttttttgtggtcccaatctcaatttatcttctcaatcacccaaacaagaagccatgagattgccttgaccacagctcctcccttaccagtatatgtagcctgttactaaagcctgttaattctactgcatctcttgaattccctcctcttcgttcccagggccacaattgcggttctaagccctgagtgtcatattaaaggtattttcaatagttctctatcaagcctaatgtatctccaccatcctatcttttccacagtttttgtttttcttaaacacagagtggttggccaggcacggtggctcatgcctataatcacagcactttgggaggccgagggggtgaatcacctgaggtcaggagttcgagaccagcctgaccaacaaggtgaaaccccatctctattaaaatacaaaaattggccgggcatggtggcaggcacctgtagtcccagccactcaggaggctgagacaggagaattgcttgaacccgggaggcggaggttgcagtgaaccgagatcgtgccactgcactctagcctaggcaatgaagtgaaactccatctcaaaaaataaataaataaataaaaataaaataaacacagagtgggctgtatcacttccatatgtaataattgctgatgacttccatttgccccacgtcaaaccaagcactctaaaaactggcccctggccaggcacagtggctcatgcctgtaatcccagcaccttgagagtccgaggtgggataatcgcttgagcccaagagtttaggacctgcctgggtaacatagtgaggctctatctctacaaaaaatacaaaaaaattagctgagcatggtggcatgcatctgtggtcccagcttcccccgggaggctgaggtgggaggatcacccgggcttaggaggttgaggctgcagtgagcagtgattgcaccactgcactccagcctgagcaatgcagtgagaccctatctcaaaaaacaaaaacaaaaacaaaaacaaactggccccccatttacacatgtggtttcacctccctgaagcctgtattccagtcatgtgtaactcctcattatgtcctaaacatgcccttgtgaaactctttctgtttcatggcaaagtcttactcaccttgcaggtcagctcaattcttagaagactttccaaactctttctctttcaaatagaatacactctgctgactgcaactttctctttgtttcaatagcatttcttttgcacctccattttagtagttatcacagtatcttgtaattacctttctggttctcctgctagacattgagctcctcgagggcagagattatggaacctcagcatccagtacagcctacctggtacatgtgtgctcaccacatgtctagaaaggaaagaaggaaggataaagagcagaaaagcatgttccatcagactgctatgacaacacagcccataaaaataactgaaaataaatttctaaatacagagtcagccatgaaaatagatttttaaggatcactactatctgccttcctcatttccactgagtcctttctttccctcttcaatttcatttagttgccttaaacttatattaaatctatctgcagttctaatgagactgtctctcagggtataacttaaaaccaccttttcgtgatgctaagaagcatcctggcatcatcagaaaatactggactaagagttgggaacttataagttctaagtcattaagttttttctacaaacatttattagtactcgttatgtgccagatactgttctcagtgcttgagatacattcatgaacaaaaaagacaaaagttcctgcctttgcaaagcttgtgttctactagagggagagagggatagataacaaataataagcataataagtgttttggaagatgaggatcacaatggccaatttggggtgaagtgaaggaggatatacaagatgcacttttaaatgggaaggtctcatggagatgagatttaggcaaagaaagcaagggatgtgtgggagagcattcaggccatgataacaggtatagcaaagtcactaaggcaggactgcttggcatgtttgaagaacagcataaggattatgaggccagaagtgagtgagtgaagggagggtgataggagaggaaatgtgaggggactcataggagacagatgatgtggatcctcataaactatcatcattagaactgtagcttttattctgattgagatgagcattcattgcagactttgttttaaggagagaagtggcatgatttgactttaagtcatttgactgctgtgttaaaaatggattgtggtccaggcacggtggcttatgactgtaatcccagcactttgggaggtgcaggtggtggtgggtggatcacctgaagtcaggagttcatggtcagcctggtcaacatggtgaaaccctgtctctactaaaaatacaaaaaaaaattagccaggcattgtagcgggcacctgtaatcccagctactgggaggctgaggcaggagaatcccttgaacctggaaggcagaggttgcagtgagccgagatggtgccactgcactccagcttgggcaacacagcaagactccatctcccaaaaaaaaaaaaggattgtggccttgtggccaggtgtggtggctcacgtctgtaatcccaggactttaggaggctgaggcagatggatcatttgagcttaagagttcaagaccagcccgggcaacatgacaaaaccccatctctacaaataatacaaaaattagctaggcatggaggtgcatgcctgtattcccagttactagggagggtgaggtgagaggatcacttgagcctgggcagtcgaggctgcatgagccaagatcatgccactgcactccagcttgggtgacagagtgaaactctgtctcaaaaaaaaaaaaaaaattacaaaggagaaaggatagatagaaacaagggaacaaataagaggccattatagtgatcctggcaaaagacgatggtggttcaaagcagggtggtggcagagaagaaaagaagtcagtgttgggatatatttttcagtaagaccaataggatttcctgatagtgtaagctgtgagaaaaataaaggagttaaagaagactccaagagttttatcctaagccaacagaagaagggagtttccatcaactgagaagagggaaggctctgggaagagcaaatttggtgtggggaatgaggatggggagatcaagagttcagttttggacttgagattgaaatgcctattagatatctaaagaaacatatcaagtatacaattggataaatgagtcttgcgcttaagatagatgtcagagctggagatttatatttggaagtaattactgaatagatggtttttaaaatcatgagactgataagatcccaaccccaatacaattatctgcttaaccataaccagattatctaattgctctgcttcttattttcctcattctcttaatgataatgtcaggtgaaatcagtgattttcacctgtcttctatgctgcactagggttctgtagaaagagctgatgggatcagagggatgtttgctctcctattgcctaagccaacaagaaaccctatatttttacaatgaaaagacatacatttagagatggtacaaactggtatttatgatgtgtatactatagtggactagggtgcgtgtataggagagtaactttccagatgaaataatgaattagcatctcattacgaaatggccccaaatatctgcttttactggtcagctatcaaaagaatatgtgtaaataaaggtacatattagaaatagtacacagttatgctagaaatgtttgccatagagacaaaatgtgcacaagatctcctcttcaacaaatatttacctaaaaatcaaatttaaaaatcgaaggatttcatttcttttagatccaattgattgcagttgagcattcagaatttcctttgaccctgagaccatggacaattggtaatataactgtaaaaaatgcataaagttagtgctataagaggacttagaaatacttcagctaattaccctcccttttcagtggggagctgaatctcaagggtcaaagtttatgctggaactggaacctaggtcatctcctgactcctagtcctgtgctcttcttagcacacacataatgctgatttcaaggcctctttagcaactcctctgaaatttgcaattaaggcagaaagcaacactcacatgtgatcttcctattttcctaatgcattaattttacattaatacttttcctattttcccacagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacaggctgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagcta

SEQ ID NO: 43 - DNA, 87898 bp, Homo sapiens
gtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctgggtaagatgtgccctttttggcgtcgttttgttctgaagaggtggggggaaggtgtggggaggggtaactcgggagaccacccagatttaaaacactctcctaggatgtgcggctttacaatttaggagagagcgaatatatggggcggggactggagggaggaaagtggaaggtcactttcgttaatgtattcatttattggattttattttattttttgtttggttttagagtggaaaaggtaacctcataaagactaaatatttagggagtagcattttgacattattgcaatctgatatcggagtgggctgtgctgatacacgccggcatttgaggccgtgttgcaagcattttgggtgggggtctgatggagaaatttacaaatgggtcctggcgcacaccggagagatatgtgtgagggagctggggggaggggcggcgggcggccctgttcctgtgtactaaggcatcgcatgcttctgcacctggcattcttaaggtcagtcagccaggttttgcatccagtcccattgacccaacagccaactacccgtgtgcaaacatggttcagcaccagggacagcagtcctggtgagggccaaagggatagaggcttgtctaacctgatagaacgtctctaaatatactcagggcatccacagagtcagagagaaggccaatgaagccacggggcactaatgaaatatacagatcctgatctgtttacctctactccctccttgatatgggaaggggactattgggcatagggtggagaacgtagttaaatgattgcataggggaatatacgtctggaaaagagttggccttgctgcagtgttggaaaatatgctgaaccaggtgaatgtgatgccataatcgtgaagtacacattaatgttttaaaaccttgctgcactgaatagaaaaaaaaaggtaaggctggagactggactcctgaaaaccctgagaatgtgtatgccctgaagtgcccggcatttaaatttacttgaactttcctgagctaagagtattagaggagcaaccatccatgcagcctagctgactattcgtctacctacctaagcaccttccccgctctccaagctttctaactaggaccaaagccatgttagaggtccactatttacattacttgcattcttctatactttcattttgaaataaagttctataaatatacctctcatatcctaccaatataaagaaagacacaaacaaaaactagctatagaaaatatcaagacagtgccctaacatttttttgtgggtcgacaatcttacatggtagttgtaacaaaagcagctgaaaaggatggaggttaaactagtttttaaaaaaattattgaaactaggcaacttctctggccccctcttctgtaagatgggtaataagacagatagatttatgataaagagacccaggcaaaacaaagagtgaaagcctcactttggagtttctaaacagagagagggtctgcttaactcttccagcactttttgtaccttactaatttactataaaaatagaatgtattttcactaggattataacatttcagtagctttctcagaatatgagagggccttttactggaaacagtcttatatgtaatacaatttggtgaaatcctgaaaaaagtaattttttgattcaaaatttgaattcatttttatacttaaggttgtggatagctattaatttgtttcggaaattagaaaacagttacttactaaaagaaaatatctttcccctatttctaccattaatgaaacctgtggattaaaatctagacaagacacaagggaatgtctttctttttgactcatctccatcttagtaaacagttgtctaacttaatagataaaatattatgtattttctctccagtaaccctattttaacctaaacatgtttaactttactatagtttataagaaaatagtatttaagatgtcttcttgttgccacagccccaccttttccatttcaatgtcttatacaaagtaaatttgatgatacattttaattttcaatttgtaccagactatcttagatgagttttttaaaagagctctataaatatgagctatctgtaatggaaactcccaaaagtggtaatttttacattctctcatagtgacagagaatggagtcattgctgtttggtgcagagaatgtgatcagagtttcagtctgctgcaatcccataaaaaaagtcatttgaattgttgagtaggactggaggtaaatagaagctttgatttataaagttgatcctgaggaaggacaataaataactgggaaatatttgagacatgaggagtccataggaagtggtacttatgaaataatacttttgtggtagacagtagtagcagaaccacctagaaagttaaagataaataaaaaaaaaattggttttttatttatgtaactcaaaagattgttttcgccctcattaagtgacaaaatttattagtctatgtctttacaaaagtgaaacaaagagaaaaataaagcatcgtagtgagaatattaataactaatatctcttcttataagtgaaatagttaatttctgaaacccaaaatttttgaaacattcacatagcttgtgctgtcataaaaaataacctggggaacttactaaaatggagattcctacactatacactgaatgcttttgaatcattatgtctggggagaaaaggaatattcaacaggagtattttcaacaagtaccctagacctcactttgaagaaaagtggtctatacttttctgatttccaaaagtttatcatcatatttaatatttaaaggtgttttgattattcatactttattattcagttgggcagaatgaatcaatttaacttcaatcttttatttgtatgtaaatcattgagaatattatacatataacaaagcataaggaatagtataaagaatacaccaacattagttataagaagatattggctccaaaaaaataaaacatatatacatatataaatgtgtatgtgattatattgaaaaactatatatataccacatatatatgcatagagattttaaaacaaatcttataactttataaactttttcagtgtaattttattccatctcagagtaaaaataccctaaagggaaaaaaatatatagaaaaacataaaaaataatttagagtaaataagaataactgaaacataaaatgtttttattttattagaataaaacaagattttgtaatatacttagagtgacaaataattatttttcaaggataaattgagcagaaataaaatggactgaatttttgatgatctgtctaaactttacttttaagtgctcattctgaatttttaaaaagaaaatacagttaatggtttatacatattttctatttttatctgctacctaaacaaagatgcttttgatgatgtttcttatgagctgctaaagtgtttttattccataattttattttacatgtttctttaactggctaggactatgcatgtagaaaaaaatattttgattcttcaatatacccttatttgtttacagaattaatctctacagacaagcttgtcatttcctgtctttctaaatgccccatctggtatccaccagaaaaatctttatttcctcagcgtactaaattgctttagttgtagacaaaacccttcaaatagtctatcctgaggtagactgggtagactatttgaatggtagggactctacctttcaaattcaaaaggttaccctgaggccattaacctgaaaaaaaaaataaagaaaaacagaacgtaaatactcatcacccagtatttcccagaacccagtcacccactactacctaaacaaaacacctgaattgtaggcagaagttgaaaattggcttgtaatttaaataatgagttatataaatgtctctttcacgtcctagattcatttagatcaggtaatttcctcaaaataattgatttaaagcatatatattttaatgatagaggtctctgttctatacttcaaaaaattgtttcattccaaggatttccgttcagattggaaggaagttaagactaattttagatactgtatctctttgctataaatattatgttactagggtcctggctacctccctactacaatttcccagccattccaagacaggcttttcagtttaggtacaagtaggctttactggaattatacatacttatcgttctccaaacacttctgccaaattggctgattaagaagattgaattataatgaaaagttataatcagagtagtttggagattgtttgaccactgtgggtgtcggcacaattcaaatgcttaaagattcatgatttcaattgagatgaatattccagatgtgatactttattcaggtagacatgcagaagacaatgcgtctttctgctgccaggggatcagacacctatgtgacctcttcaaagccagaaaccaaatagccataagataatatcaattttatgcgctgcttgtgtcatgttatacatacacactgaatcaaataatacacacaaacacaaacacacatacacagacacaatcctgtgactccgcaaagtatttatcatcaaccacatttgagagactaggaaaccaagattatagatagattaaatgacttacttaaacataatagattagaagcaacatactataataagtatgaatgtggatataagtaaacatgtatacatatataatgatgtttatatatgtgtatacatatgaatcataataacttgggtttttagatctgtcaatattatcttatgtgtttttttaatcagtttggggtctcaatccatcaatagtgttcctagaagtgtaacaggtagactggatgatctataagttatttactagttttaatattcatgattctctcattctgtcttcagttaatagaatctacaacagatactttacatccattcagcccactgaataaatcaaaatgtcgaatctatagaaggacatggtttaagatactcagtctccaccaataacatcactattacattatgtttttttgttttgattgaaaggtctagacagaaatgcttagcagcagtctgaaattaggttttttttttaatataagagcatattaaatggaattatttagagctgaacaaatattatgtttagaatatatatttcctcattgtttgtgtctatgtaagtaaagcatagtttaatctgcacttaattattcatccagaaacttaactatagcatgtcattccatttttaaagaggagatcttgctttttattgagcaaatctataggaaacttgctcaatgttgtcctccagttttcttacaaaaattcttagaaaagtggaagacaaaagtgaagcaacgatactcaatattaaagtagaaataatattacaacttcatatttggatatgtatagttttaatatatagatattcaaagatgacatatttttaatcaccccaatcatactagcaactggttaattaatgttactatgtggtaacaacagaaaagctcttatgttttaatttctagagtaataagaagctataatttctagaaagtaatagggattttacagttttacagaaacgtttgcattcacagttttattctctcagtagactcatgaattagatgaaaaagataatattttcttctgacaactgtagaaaatgagatattgagagattaagggacttcttcaaggatcctttactattggctgtagaacagagttaagaccccctccttgaattcatagcgcaatacatcacattgcacaagtatagtcaccccccggctttttttatctaaatgtaagaaaatactttggttgtttagagatgtaaaagtcctctctaacttgcattactggggagggttatttcccattcatttgtcccccatactagagaataaatttcctttaaaaaaggaaataaaaagctcctttcaagttacacattagtggtttagggtaaaaataaaacttaactctaaatcatattaatccctacagtattatgatataagagcacaaactatggcaataattctatattattataaaaatcattgtataactctgcatagataaaataccatgtaaatgctaaataagtagcactgatacaacactctccacccattcataaagaaaaccatgtaagtaccaaacaacataatcgtggagaaaacaagggttgttttaaagcaaagatcctttgttataattgaaaccctgccatgaacccaagtgttgctgtaaagccaaagtctacctagtaagacaaatatacagtgtgtatttgcttaaatacatctaaagaaattgcagaacttactgtatatttatataaataaaatggcaaaaacaagctgaatataatatgtcattataatcttgataggaaaaaatgattgatgctttcacgtgttctttttttgctggttatcagttcttttttataaattgcttttgaaaacacacttgagatacataattgaggaaagcaactctaaacataaaagtagaaattaatgtataatttcttaattaatttatgaaacgaatatcatttgagccaattctgggatttttgcattatagagaatacaggccaaatttccccaggaattttctaaccactcttgtttagagaatgctaagaggttgtaaaagtttttgtatttgtagtagagataagaattggcctcttagtctttttatggtggacatttaagagtgaattacctgatttccgtaggcagaagtggagctacctcccactatggtaggagataagtaattgaacagttccttctattgctaaacaaataaccctcttccacaagtactcctctgtcatttaatccttaaacttctatcacctagctgcgaggagggggaaggaaagaaaaggcactgagggttgttttactaatattttatagaaagttctattccttcttagcagtgtaccacatctatattaaatgagaatatgatgtttgtcatcttcttttctcagtatcgggaaattagtcatgataacatagggaaaattttgtataacattgtgttccctgtgcaatgtgtttcacatatccactgattaactcacctttttgaagtttttgctcagagctcaccttctcaataaagcctgcacctaccactcagtgtaatattgcaaactccactccaccttgtactcctaagtcctctaatcctctctgctttactttgccctagtacttacttatagcctttagtaattaatcagaaaaaaaaatgttatttattggtttattctttttactttttgattttctatctctctcagctagaagccaggacccacaacagaagagatgccattgatacaactcacctttcatagcatgcctagcctctaacggatgttcaataattatatgcttaattaagtaataaaaattgcactcattttcccccaaattttattcttttcctaaaaaggaaatattttcaactttttttacagtatctcactgtaagtcagcatatatggctgtcaggaaaaaaaaataaaagaaaatgaacaaacaaaccgtttccacagcatagtatacttgttaatagcataagctcttcagacacacttgatcagggttcagtttgatgaccctcagtcaaccagtttcactctgtcttttcatattaaaaaaggaagatttgggaagctgaggcaggaggatcgcttgtgcccaggcattccaaactggcctgggcaacatggtgtgaccctatttcaagaaaaaaaaaaaaattaactgggtatggtagtgcacgcctgtggtcctagcttcttgggaggctaattcaggaggatcacttcagcccaggagttcaaggctgcagtgagccatgtttgcaccactgtactcaagcctgggtgacagagtgagaccccgtctcaaataaaaaggaagataataatttttcttaagtttattttgagtaggaattgatataatacatattaaggggcacatagttagtgacctttacatggtgttatttttgttactcttattgttattgtttaatacaggacattatttatcccctgatatatcaccagaggcacaagtacgctccccatccctgctaaactctgaactttgtgggagtgtagaagagggatttttttaaatacaacttttctaattcttcagtttcttgctttgacttgtatgagataagcaaattgggtagaggtccctgaattttgagaatgcctgtgtaaacattgaacttagtaatatctctaacaatgtgaaatagcttctatttaaatgagaaaatacatcctgtcatacaagactccttcctgaagataattttgtcactgtatgtaaagaaggatattttcccaaagacattgtaaaacattatccctgagttgctaggcaaatttattcaactcattattcagagcaaactcaggttgctactcttgatggtcaggtctatattggacagcatgaagtggaagcagtggttgtggaatctggagagtaatgaggaaggaaacaatctaagctggtattttgctattcagggtcatgactaacttttcatttttctttgtgcctcatacatctgatcatataacaaaattcaacatcatctgtcacctgggtcactacaacactgcccaaaatacctttctgaatatgtttttgctaccttccaattcactcaccacataatagacttttcccctgcaactatttttaaataaagacataatatagattcaataaattattcagaatttaatatacagttagatgaagtgttttccaaatgtatgcagtattataacaactacccctgtgtgtgtgtgtgtgtgtgtgtgtgtgtgtgtgtgtgatgtttctatcacatcagtatgttttattgtgcttctttaataatcatcattcttcttctctccaatccctgcttgcccctggtagcctcttttccaatttctttcaccatagatttatatttttctgttgcacaacttcataataatgaaattaacaatgtgctttacctttttaacccagcttcttttgctcaacataatatttctgagatataatacttatgcatatgagttcttttttattattatgaattccatggtatgaattacagtgcatttacccagtatccccttgatgcttctagtttgaggctaattgaaaacaaactgtcatgaatgttattgtacaagtgttgctgtaggcatctgttattattcttgatgaaatgtctaggatgtagcatagatgtattttattataagaaacttagcaaaacactatttcaatgtatgacagtttaagttactttaagtcattgcaaccttagatatcatctgtctttgcattagttatctatgtctacattaccagttatccaaaagttagcagtttaaaataagaaacacgtcttattttgcagtgtctgaggagcaggaatccaataatgggtagcttggtaattgcagtttaggatctctcgtaagattgcagtcaagttgtttagcagggtcctggccatcttaaggtgctagaaaatcaactttcatgctcactccaatgtggctattaaaaggaagttcccgtttcttgtcttttgagctctacatggggttggagagttggagagaggagacagagaggattgggggaggaaaggaggagggaggaagggagtgggagagagggctttcaagatgaaagccatagtctttacaagaaagtgtcaaaaattatacaccatcgcttctgtcatatgctgttggtgatacagacctatcctgatgtataatgggagggatctacatgaagctgattcctacttagtaggaagtagcttctgctactaaaacaaaacaccatagaatacatggcttataaacaacagaaatgtgtttctcacagttctagaggctggaagtctgagatcagaatgccaccatggctgggttctggtgagggccttctggtttgcaaattgctcttctcattgtatcctcacaaatagtgttatgccacattaaaattaatcagatccctttaaacactgggtttattttcctgtcacctttacaggcattactttcagagcatcttactatatatatatatatatatatatatatatttttttttttttttttttttttttttgagacggagtcttgctctatcgcctgggctggagtgcagtggcttgatctccgctcactgcaagctgcgcctcccaggttcatgcattctcccacttcagcctcctgagtatctgggactacaggtgcctgccaccatgcccggataattttttacatttttagtagagacgaggtttcaccatgttagccaggatggtctcaatctcctgacctcctgatccacccgccttggcctcccaaaatgctgggattacaggtatgagccaccgtgcccggccaccccgacctattattttttaagcatgtcatcttcaatacagaattttcatcagtgtgatggctcaggatttgagatataattttgttatagatattttccatttaaagtttaaaaagtgaggtcatacatggaacgatatttaactaagtgaattattgtattttaaagcctgaaataataaaagtaactttgtctagataaacaaaagtctacaacctttcagtcacattgcatgtcacttcataaaaaaatcttttatatattaataattaaatttatttaatttgtttaaattaaatagattaatattatataattaataatttaaaaatgaaataaaatgaactcagtgtcataaaaacaaaaatatgtgagtactcacatactcctcaaaatatctattacagttgattgtaattttccaggtactcttgtggtcaacaggccatttacagtttccatggtccatgatggaagtcctcttgggagactgacttccctttgcacgtgcagctcaatttctctgatgaccaagcatcacagtaaattctagaaactcaaatgaggatggaaagatttcttgattcaattttagtctcctttacttcaggttgtaagtgatatataccaagcagattcttaacagttgtttaagtttcaataaaatatatcagagaagtgcacatgcacgtaaagcacaaaattagagattgtagtttatactctgattcaggtgacctacactatattatactctcctgaattcctatttattttgttaatcacgttttattaattcctacccactatgttgctagcaccctgccagctgctgaagatatagtgctgaacaaggcaaacataatccttgctcttgtaaagcctatattctaggagaagggcataatttaaaaaaataatatatataatatgataatatataacactgcttttataaatttacttgtagacaatgtcatacctatgtatttatttacttcccttattgattctgatacaaggtaattgtgtacccagatatatatcttatactcaaacattatttatttttattttatttacttatttttattgagacagggtctcactctgtcgcccaggctggagtgcagtggtgcgatagctcactgcagcctctgtctcctgggttcaagcaattctcccacctcagcctcctgagtagctgagattacaggggtgcaccaccatgctcagctaatttttgcatttttaaacccataaacgcacatgattctgttcatttttcccctgaaataagctaacataagataccatttggcccttgttgagctctgaagtactgtgttaaatgtagaatgaatataaatgcaaggtggacaaattccttcccgcctacttcctgtcttcctgtcttcaataaatgtttattgagtttctaatacttgcatgccactgtactaggaaatagatcttgatgtctgggggaaagcagacagtaaacaaacaaactaaataagcttcaaattgtgatagtgttgaggaaataacttacaagtgtggtgtgttgaaaataatcaaataaattttactttgcatatactggccagggaaggcaattatgaataatggataagaagttgagactatgagagaaggaaaggagcccagcatgaaaatgttgaagggaagaccattatcatcataggtaacagcaggtacaaggatccccaaagaaataagcacttggtgtaatttaagaatgaaaggaaggtccaggtgactggaagattgattgagaatgaaaaagtctaggggaagaacttgggaggcagaaagctatttcctaatgtacggtctcaaaaccattgtaagtaatttgaattgcattctaggtaaggagtttggataaggggtaagacttcatatactaataccatcagtttcattcttagggaaaagtgtacctatatgatctggggaatggtgagggttgcgttttacctgccagttttcagttgcttggcaattaactcaagtgctgacttttagcttcatcagagttatataacgtgttgttctacatcctactgcaaaatcttagcgagaccaagaaccagttattgattttactattatgtcaatgatttaaaacatacttattttatggcattgtaatgaaataattgcattatatttaactaatgtgtgtaaatagatttgtttttacagagctaaatactttgcatctaataaatggcaaagactattgctaaattccaacttaattattatgatttgtgcattaattgaatgtttaaaattttaagggattctcatagagaccattgacaaaagtatacttatttcctaccgataaaatttgttattgaacttaatctgtgtataaatccaggcaaatagtaaaaaagagattaaaaattgtatacaaaattaataggaaaccagagtactagttcattaatgaaattttatttctcccaaaaaattttttaaaattttaagcccaattatctcatactttattattaggaaatttccacaaatatctaatggcagagaatattttttaaagtttaatgattaggttacagaataatagttgtatttttaagttatcatacagcataattgacctcttcgtgtatacttacatacattttaacacatatatttgttctcttgagtaccataagcacagcccaaatcagtattcttggtttgagtggtacttatggtactcacaagaacaaaacaaaagcaaacaacaacaacaactacaaaatcctttactccttaaaactgatctgttactcatcattgaagatttttctttcaagaatataattagagacacatacagttcatttagcataatacttttgagattcatctaagttgttgatgtgtcaaataagcacaggaaaagaggttcaacatcattagccattacccattaggcaaatgcaaattaaaatcataatatgatatcaccacacatctattagaatgggcaaaataaaaaccactctagcaagtccaagtgtggtgaggatgtgaagcaactcgaactacatagctagtatgaatgaaaatggtatagctactcaggaaaacagtttaggattttcttataaggttaaacatacacctaacatattacacagtaattccatgcctaaatatttacatgggataattaaaaacttatcttacagaataacagattttaaaacacagtgactatccagctaagttttttcccagaaatgcttacgtaaaaaatgatcacattcagttttctagacaaaatgaagtttttttccccttgagagtacatacttgattgaattaattatgaacttttcagtgcttatgtgttctgccttgatactactggtgattatgtacccaatggatattagaaagactagagaaagtaataatagggaagatgggggaagaagcatggattctataagagcctaattttacaatatgcacattagtgttgcagccgtttgtaagagatgataatatactgccagaaaagacagtactttatcttgttatttcattaaggcactctcattttgtaatatgaattcatattaatttaaggcttttagccttattgtgtgttgaaagatctaaacttgtaaatctgtaaattacacaaacagccctcttctattatataaacctttttgacgtaacacatgcttaaaattggtgtgaagttagaatgttttcaaatttcattggggattttttatattgttccagaattccaggaacaaatgtaattttggactttccaaaatgggttcatgaagaactaatttgttcactctcaatatggaacttttttaaaaaagtaataattctaagtgctaagaatagtgcttagctcataagagatgtctgtgaataaacacaaatgagtgaatgaacacaaatttctataatctggagtattcataattcctagttatgtaaattcatattatatagagataaaaataagctatttatataacgagagtaggaggaaggaggaacaagaacagtactaacaacaagaagaaaaaataagaaaagacttgattaacttttaaagcgaacaataaaaccttgattttgagaaaatattttatctataaagagtcgatgaaaacttagtagtagtcttctagaattggccatgaccacgagggcagatttggcatttgtttaccttgaatctaaagatgaatttttagcacaattttagaaaagaaagaaacaaacaaacagaaaagtataaaaaaagatgaacaagaaaaatttccagaattatggtcattcagatgtatgtacacatgttgttaaaactagtagtgtatgaaaatgaaaatttaatcaactatctgaaaaattttgctccaccatttcaaatatctaaacatgaaaataaaattggaatatttcatttcctgtcaccatagagcaatatgaattttcaaatacattcgatacatttgaatatctgcctaaatatggaaccagccttcattttcatacacttgttctcagtgacctttaaatgattctaaatctgagacagtttaatcttttgttcatgtgtcatgtcaaagtgcacagaaaatctcctatccatctgtggactccttgcaaatatttaaaaaattatgtatgtttgtatatatgaacgtttttgctacagaaaaaatcaaaagttttatcggttcctcaaaatattttgtattctagaagaaaactttcttcttacccacataaattgagatttgaaaatgaatgaagaaaaacattgatagaaataacctcaatatcaagttggagatcctgacagagctaagtcatgttctacattgtgagaacgtttttggtattgtcttgcattgttatttaagcgttgtttttttcctagctgttcaggtatttgtctccttaaatagatgaggagtgttttgatatcagcattatactttgtacttctttccatctgcactgttttcaaaaaagagtctcaaatataagctgtttaatgaaggatcaagaaatctgaatctgtaagtcactgtttcccaagttcaacgttttttgccacatctaagtaatacgtggtcatttatgactgaacttttttcataaaacaaagtattttttcagtaaaattattttatttaatgcatttaataaaaacaatacaaactggaaatcagtgtcacttttcatattagaagacaactgcaaataaattcaatggtaccagaacaatgtaatcaaattttaattacgtattttgtctcccagatatgccaagcttgctcttgttctcttcagaaggcagattagcaaattgaaaagagtggctaaagacaaattagaaataaactgagactttgccctcagtataattagatatgctgaaggaaaattaaaaagggaaaaactttctaattatatgtttcaatgtcttttaatactgtacctatgtgacacttaattaaaattgtctgtgtactagagcagatgtcccaagccttaggaaatgctaatacggggctatcttaatatcacaaaaatattgaagatgatgctattttgaattttcagtttaccatgaaacactatagcaagtgacgtctgacttacctaaaagcagttaccaaagtaattatttactctaagaaaagaaagtccaggtggttctatcatactctcttgcagtagctcttaattacggctgcaccttagaattagctgaataccaaagtcttggtctcatagagaccaattaaatcagtataaggtaggatttcagactggcatttctttaaagccctccacttaatattaacatacagccagggataagagtgactagcctatgtcttattttgaaaactcagtatatgccgcaccttgcatatttgtaatatgttagtcatcatataaatgaagaaatacaaagtatttcctacttgatacatttcttgatggtaaataattacgtccttctcttttatggtttgcatatcttctctggttaaaattggtcttggattttcatagaacatggcaagaaatgcagtcaatgtgtgtttctggagtgaaggagaggaagccttctttattacactgactttgtcaccatgttatcattatagtccaataacaagtatagtgtataagttctaccatttgataaaaaaaaaatgctgcatgagactaacgtaattatgaacccacttcaggttactgcctttaaaacttccatgttagtgtgtagtgtgcaagacaagctgtcccagttttcccaaggtcatgcaggttatgaggccgtcaatattgtatgtagtgatatttcacaaatttgcattgttgtacgatatttcattatatgcatatgccatattttatttacccattttactgttgatttgagttttatttatttctgtatgtgacaaataatgcaactgtgagcttccttgtacatatattaagtggaacgaggtcatcatagcttttattctgtagcaaggtatacacaaatgagaaagtgaaaatactatttttaacatgttgtaaataattctactgaagtgctttataaagagataaatgagaaatattccagtttaataatcatttgttaacatttctttctaaccacaatttaacatgcatatttttctttctatcctacccagcatccatggacagttgacatgactttaggatttgttcttgtgttaaccttggcttgctttgtttctttttttttagtacttttttttcttctttttttttttactttttttttttacatttattttgagttcagtgatacaaatgcaggtttcttatataggtaaacttgtgttatgggggtttgttgtacagattatttcatcacacaggtattaagcttggtgcccatcagttatttttcctgatcctctccctcctcctacccttcactctctgaaaggccccagtgtgtgttgctcctctctatttgtccatgtgtcctcattgtttagctcccacttataagtaagaatatgcggtatttggttttctgttcctgtgttagtttgataaggatagtggtctccagctccattcatgtccctgcaaaggacatgatctcattgtttttttatggctgcatactattccatggtgtatacgtaccacatttttttttttatccagtctatcactgatgggcatttaggttgattccatgtctttgccattgtgaatagtgctacaataaacatactcgtgcatgctttgtttcattatggtctaaaaaatattttaaatacatgtcatttgagttttcccatgcagagaatcatcagcacttgaagagagcaatggcaaccatacaatagcatgttacataggcagctccttttagtattaactgtaattgttacatgggcacatatagaaagagagtgagccacttactaagttaatttccacaaatattgaatcttcttttaaaaaattcatactcatattttgaaaactattcatcgggtgtcttgccaaatgcccaacacttacaaagttttagaaaacaacacctttgaagacagaagcagttcttgtccttagatgcttaatgctctgcttttaacctccatagctaaacttgattagtttgttttcttatgaagtattaatgttataaaaagcatataagattaaaatataactcaatgcattatcaaaaattgaaataaaaacccatgtaattgcaaaatgtgtctgaaaataaaatattgccaatgtcccagaaaacgtcttctttctttcctagtttctgtcctctttctcttacctcaaataactgctgtcctaactttgagcactacagataatttttcttgtcattaaattttatgtaacagaagtgttacatatttgcccatgtatataatgtctagacatcttttgctcagatttttatttttcaaatttattttgctgcatgtagcaatatttcacaaatttgaactgttgtacaatatttcattatgtgcataagccatattttatttatcaattttactgttgacttgagttctattttttcctgtatgtgacaaataatgcaaccgtgtactttcttgtacatgtctttaagtagacgtgtgaatgcattttcttttggaaataatcaatagattaaatttctgggttatagagtacagaaaatgttcattattagcagataatgccaaaatattttccctccagcagtatagagtcctagtttctctacttcttttcccttttatttaagaagggttgaagcaaagaataaaaacaataaactatgatagggaggtgtaatccatagaaaatggactctaatgataatttcagaacataacctgacattgattatttttttctgttctgttccccacaatgagcatcgtcactgcctctccacgttttccctcctcaccttctgaactaacataattttaatttggtatctgtgaagctcatgcgcttttggggaagctgttttcatattttatgctagtggtaggtttatataatgaaggttaaatatttatcattttctcattctctagccactgatatcagtttcatgtggctgatctcatttaggctagtgatattagaaaacaggaggcttttggggggcttttagaaaagtggctattttcctcttttagagagagcttttggaaaagtttatctttctgtttttgtggatacatacaaagaagcatagaagggaaaagttgttgccagaatcttgtgaccacatagatacttctttgggttgaagtcaatgccatggaggatagaagagagagatagaaaaaattctaagattttgaatacgtagttaaggaactgagtcgaaactcccagaagctcatcttaccttaggatttacaattatatctgtcagtgtctcccaatttagtttgaatgttgtgatacttacaattgaattcatcttagctaataaaatcccacagacatttatttgatatgcatcatttgtggctgttaataaagtaaacaatttgcattttatatattgcaaactaagtgtctgttaattgattcagccaaacacaccaacagctgttagcctaatatcaaaaaaaattaaacaggatgtgaggtgagaaagtaattttaagtaggacaatttgttagcagaatggtttactttcctgctctaattctaccctgtttgcatgtatacactcacatgtgcacactcatgcatagagcaccctctgaacaggttctgcatagagaatttgcatgtccttactgggaggaataaaatcccacaggccattgaaggacctatatgaaggagcaactagcgccccaatggccccatccattgaacaccactatgtctctaaagagtagccagtcctcctggatagtactgagtggagtcccccttcccatgatcatatactgagttccctttgccttctgaggatgtacactcacctactctgcctgttcctacactgtttaccaaagcccaccttttgcagtggctgaaggacatcctttaaattgaactagcttatatgtgtgccttgtctctgttatatacattgctgtccaaacagagggaagagtttaaatgaggcagatgatcacatccattacgttaaattgcaagctttccttttattcttcagtgtggggagatcaaatcatttgtatctgcagtggcaagtttatgaaacctgaatgttattaaccttgtgctaaaggcatcatgtcttttattggactcaggcataaattaatttattgtcctaagggaaaatgagctggaacaatcatttattttggatgatcttattgtttaatgcatgtatagctgtagattctttggtcctaatttctttctcaaagccgtgaagaataatggttaaatgtttagttttggccaactaaagtgactattatgattgtaacagtgcttctttatctgtaaaacaggaataattatgggaatatcagtgttttgaggattaagtgagagaatgtatgtgaaatctttaaagttatacctagaacatagcgaatatttttaatattatgacttctccgaggaaaactggtgagcaaaaaattattcccacaaatcttcattgagcacatactcatgaaatttatagtttagtaatgaagacagacaatagagaagtcaacaaatgcatattgtgataaattctatgaaacaatctcttggtagaacatgtgatgggtgagtgggcaacaaatgtagataagatagtcagaaatggtctctacgatgggatgtttgtattgaaacatgctaattagtagattgaggagtggagcagaggaaaggttgaaggcagaaaggacagttacatgcaaaggttctggagtttggcctgatttccagaacttaattaattctcgggtaacatgatgatgtacggaacaagaaattcctgtattaatgatacttttggggcatgggattcccagtggaccctacagccttgtgagaatctagagtagcagtgagtccctgtgcatgtggtaaaggaaggaatatttatgagatgtaagtagtgtatattcacaatttagaggtgacaatggagcagaaaatccaatgcatgggaatttttattagaaaaggtcaaagatatcattttcccgcatgtatgtcttgatagatttattttgacgtataaaatactttgcatatgaactcattgcacttataaaaaagtaaaccaaaaattgtaccaagaaaatattagtgacaccaatgttatgaaaggaaacattaaaaatataaaaatagtttaaaaacacaaataattaatttttaaaatccaactacttacctgtgttagagaaggataaatatatattcagtctttattatgtcaaacatcaatagatttaaggacacctgaacaaacagacaaatgcctttatttctcatccaaatatttgctgttctactatcctgggcaatgactagattttcctcctctacccctaaacttagagctttattaaatatatcgaaatctgaaatacctaggtggaaatttaaaattccagaaactgcatgactaatcttcacaatggcaaatatccagaatatgtaccaaaattaaaatgtctacaatcttgttaaaattgtgagcaacctctcattgaacagtctctatgcagtatttgttgtgttttataagccacttttatccttctaaataagattgatttttacttctaattacaagtgtgaattcctgtttgtaatcatgcctaaattcaaattatgcataaaactgtaatgatgagaataaaagtgaataatctaatatacaacatggagattcagatttagatctaaagcaggaacgtgagaatttttatttaaaaaaaacccatcccaacacatacacatacacgtacacgtacacgtacacttacacgtacatatacacatagacatacacatacacatacacataccatacacatacacatacacatacacatacatacaggaccaggaatatgtgccactggtctaaccactctataactgagatcctcaaatattaatatgtatatgaatcatttgtgaaacttgttaaaatagcaattctgattccggggtctgggtgggtcccagagctctgcatttctggcaagctcccatgcaatgttgctgctgtggccccaggctctcactaaggtgattttctaaccatgaatatttacaaagacgaaaacttcacattcttttctgacactatcactcagaaactatcactcagatgacaaaaatgtttttattatggttagttaattgaaggataagtttaatttcagttattttcctctgtaagaaagtatttttaattatatggtaccaggaggagtaataacttctaaaggccattccatgtagataggtacctttagccagaagttcaaatatgtttgctctctatccactcaactgttgagtgaattcttcaaatcattatcaatctgtttctgcccagacattcttatggagtctacagttccatagaatgtttcatctaatggtaagacttcattattcctagatagcctatctgtgaatgcagaggtttttatgtccaaagcactctagagaaagaaacagcgtagctttaataaaagaagttcctttttttaaagacaaatctggaaacagtcccaggttatgcatcagctcctttaatttagacctcagctagaaaagcttaggagaagaaaaagttcatttatttataatgtagatggccattatttttcttcctgaaaaacatttgtttttagttctcctcagcccatattgcattaaaagtcttgaagcagcatacatagatgtaggtttttgttacatgtttgaagctggtgttataaatctatcagtggtcactttataaaatgattaatataatatttataataatatttgttccattattaaggaattttgctattgattaattaataatataataattgtcatggacttattttcagtactgcgtgttaggcactgtgctaagcacttaagcattgtcttaaccttacacgggaatgtaatatgagaactaatattaagcctattataagatgaaaactttgagacttatcagggttaaataacttccccaaagttgttaacagtaagttccaggcaagccacaaatccagaaagcagaactagcatttcctgattcccaaacaggtactcttaagtactctattttacctctggatggctaagtagactcctgaagtgtgaaaaaaaaactaggtgatgactctgagggaattgttggagcaattctggaaattagtcttacttctaaaaaagtatcccttatcttttcactttatgtattttccctcctggtctgccagataatagtaataacggtaatacagcaccattatacttgactcatttatttgttggcataaggaggtgccataaacaaacaaactaagcaatttagtacatattcccttttcttgaagaaaatttaatagggtgcatgtgtcttgagagagaaagagaaagagagagagagagattttttgaaaaggcacttttgcaagaacaatttaaaccgtaatatattctattatggcatctgacgaacctaccatatccttttctcatgagttattggagggatttgaaaattactttaccagagagcttttttattttctttccctaaaccagtaagatttgggtcagaggattaaagctctattaggcagagtttagcagtgctctggagaaatgatgaattgaagcccaagagggattttttttctggcagcacactggcctctgcttgcgtggaggcttttctctctgagagctgacagaaccattgcccagcccattatacccactatgggcactctgtgaaattaatgctcctttaaacttcctatgctcactaaagtgcaagatgtaagacactgggtatgttaggccttttgcagatgtatttttgtgatgtttcctagtcatacagctttaaaggaatgaaaaaagaggttactgtaatcattaagttgacccatgacaataattactcttaagacttcatcctctatccttattctcaaaccagattaattacataatcatcttctgcaatatttagtcatcaagatctatatatatgatgtacataaaacatatgtgcattcatgtgtacacacatacatacacacacaggtatgtatatttaactacattgtacatgtatatatacttgatgaccgagtatgaatgaagaaaggtgataaatctggcttgagaatatatgaatatatacatttatttattcaaggtaagtgtggcaattatgtcatagctgacaaaattcattctatactatatgtttagaaaaataaggtaaagatgggggcaggggtgggaaatgttatattttaagtttgcatttttaaaaaattttactctaaactacaaaagtaaccaatattcattcagtgttgataaaaatggaaatggcagcttttgcacgggtgtgtgtgttgcccctggatctggaaaatatcatcatcttggcggggttgccttgggacttgggttagggggagaggtaagctataggaattccagtccccttccagagtcattctcaggtggcttccagcccaattgctgaaagggtttctgataggtttgggcatagtgaatataatgaaagaatattatgtggctttttgatcagttataacaagtcatttcatttctatgattatagcacattaactattgcatttgccatgataaagggtggtttaaagtctgtaacatttttcttcatagtaccaggttcttaacaaccaaagataaatgatccacctttgccttcagtgcaagtgaggggaaaaaatacacataaacacaccctgggggaagcaaaagcaaagagattgagctctctccttagtgttcaagttagcggggagaggcatgtctggcagtttgtgggagggaatctaattatcagtctcttactttcattaataagttggggcaagtgaactcctcaaagaaggaaagagcagacattatacctgaattcttagactacatatgatcctttaacctccattttcacacaaatagttttcttataattccttcaggagactgggaagtaggcagaaagaacatcaaatatgggaaaagtaaaaataactggcaaaacatggtttatttgtccatgggagggcaaagaattctgaaaacctgaagcgtacacttgaatacagttagtctccatctatgcagtttaattagcacaaccctcaagggagaattttcagtttaaacatttcttttatcctgttttatttcttcttttccactggtggtctgtggataaaagtcaacttgtgtgtaatctatgtgttttttgaccaatatgttttttcttagcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggaggtttgttaaagtcttttgcgttgtgctatagataggagcacataaacatgtctactttaatagataaaacatcagtgtagttcaagagcaaggaagatttaaattatacttttttatatgttgtaaaagtagtgtttaaatagcattcaggcctatgagtgggagaggtgtcaatacattcaaaatgaagaaatattattttcaagtgaagcttgagagctagagttagaaattcacatattgctagatatctcagatagaagctgtaggaaaaaaaaaacaatgacccctttatgaagcaacataaacaaatcaaacaagacaataacagtaaagagaggatatattgtttgcctgtttttgtgtaacaaacaaccagaaaatctcaatgacatatgacagtaaacatgtatataatactcccctcagagatatactaatctatgctaaagcaagctggagctgcttatttagggcaactgtactttacgtgttcctcgttctactcttgggaccagcaggtagctaggacaacccttctcacagtggtagaaaacagccagagagtaagtagaagctcatgaggctgaatgcttaggcctagcactggcacactcgcttttgtatatatattattagccgaagccaatcagatgatccagcccaaagtcgagaggcagaggaatagccttatccaggagaaggcaaggatgtgaatgccggttatagagaattcagtccaccacagtgagttaggacatgacactttcaaggaaaaaaataaagaaaagactaatgctcttgttgttcattaagagttaaataaagatggagaccatgcatttggtcatggatattatactacagatttttaatatcagtcttctctgaaaaataggtacataatgggtttccatatggttttctcatattatctgtggtatcacagggtacaataaatcatcagggaagattaattttgtgttggtgagaggagtgtgaggataatgtggtcattaaaggaatcaacagggaactgtgatccaaaaccaatttatattaccagtttgctgtttatgtccacttcatgttctgaatgcatatttttttctgagttattaagcaattatttttctatatgggtccagtcagggacatgctcaagtcaatttcagagcttgaaggaaacatggtaaaattcaagatatctgagagaaagatggagaaaagctaagagcagcattttctaatttattcatttttatgttagttttaaaaggataattggtttcaaaactctactatgcgtgcttggtgcatgtgcatacttaagaaagatatttctttgaaaacaaaatagttattcaaatgtggtgaattagtaactggtaccaaattagttgtgaataaattacttctaatgtagctaaataaatctattctagaaaacaaagattaaaacattaaaatcttgcacctctctatgtgcacacatttctatgtttctctttacagtgaagccaacgttaattcacacagacatgtatgtgaatagcattggtccagtgaacgctatcaatatggtgagtttccaaataaaattctttgtctgttttattagcatgtttgagagaaaatgtgatgtcatggaaatagcaaaagacatgccagcaaaaaatttaagtttaaaactttagaagtgaaagatagtcttccagatcctttttttcttgtaatatgaagataattaaatgttaagtatttttatgagaattaaatgggaccatatatataattaatttgtgtaaatatgctatgctgttgaaattcaacaatcggtgtttacttgccaagtgctacttactacaaaataggatatagtactcaactacttattagaacattgatagtttggttcaaatcagaaatgtttctcagataaaatagtgtgtcagatgtaataataaatgtaattctgttcttatgtaacactttctacccaaatgtgaaatacaaaactagactggagtccaaaatatgatataatagagaatgtaaaatagagtagagcagaatggagtacaacataacataaggtaatatagtattctatattatacaatattatatatgatatagtaaaactataagtttaaaatcatgtttaccaagctagcaataaagatgctctgctaagtgagagattgatgtgccaatcgaggtgatatatcatcacctgcatactccaagctaataagtttgcttgtttagtcattaaacaaattctaacttctttataaccataattctcagaatatttagagttctgaaataaattctaaatatctaagaagtagaggctatatagatagtttatttaaatgcagaactttcttgttttaggaataacagtccccagaactgttctaggatcaaagtttgtgaaataatagttttaagaatcaaagttttttattcatggcttttcttgccaaaatgtagaatataaattaattaatttttatttctactggcacatcactaattggttgacaaaggatttcgtaaaacaggttcttttctcattacttgtagactgtaaaaatgaaactaaatgatgaacaagggtggaatgacttacagggtagaaatgtagctaatcacagtgacacccagtgggaggtggtgcaaggaaagaaaacagaacaatgtgattgaggcaaaagactcaggcctaatggtctgaatttcacaccatatctgcttttttttttttactgaagtcaaccgctctccagtttagtgatatgtatacttgatggaaataattacagtaatttgtcactatagcatttaagaatgcattttatgatagagattaacagagtattataaattatttttaattgttaatttcatcttgtttagagaaaagaacaagtaaatagtgtaagtaaatagtgaaaaaaaccctcttcttgggggtttgttctctgccaggcatgatgcaaagcaccttttgttgattgcccttttctatcctaacacggcctacccagttagattcttcatgatccctattttaatataggccaactgactttccagatctcctgcttatgacttttttgcatattctgtactttgtttcactctacagtggtggttctgaatctgaacttctttttccctctcaggggatgtttgactgtgtctggaggcaattttagttgtcattacttggcaggattgagtatgggtttggggtttgctactgtcatctaatgagtagaggccagggatggttctaaacatcccacaatgcccgggacagccctcatggcaagaaactagctggctcaaaacaacacaatgctctgctctatagacatggaaagtaaaggattgtatcaaggctatcctcttttgccagaactcacttagacagatctactttttcataaaagtatcaaacatagctacaaaagatgggtgagacagtaacctcctcagcaaaactctagctttcttttgaactattcaaagccaagatagctttgcttcatattggcaaagaaaacaggaatgaaatataccaatatttaaaaagataatcttactgtgtacaaattttctgtttatcattttattaaaacaggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggtattcttttgcaaaaggaaaggagtaattgttaggaagaaaacaaacaaacacaaaaatcaaccttaagtctctaaaagaaaaaaaaaaaaggaaataaatttcaagactgcatcagggttggcatgctatcaattagtatatgacatcaaaacattagttttttctttttgttatcaatgagctttttcaaagcactaattataggcaaagcttattttccacaactgctgtgaaaactattttttgtcacaactgacctgaaatttcctttgtcttgcaagatcatctgacctttgcacctacgctttgcactcttatgcttggcaatatcttcatttccaaggaaatagttgctaaaagagaatttttgaggtgtatgtctccatacatccttctctttttagcttcacaatagcaggcacctagaatctattatctttcatctcctggcaccccacttcccattatgttaataggctatttaaattaatttgttgtctatcttgggaatagacatgggagaaagttgaaggagctatggttcagcctctgaaattaaattctgaaattaaattgtgaaattagagtaaaatgctaccttaataaaataattattttatgccattaccttagcacttcatactttgcatttaaaacatttttacattgaattttctcattggtgggaatacattattagacagaataatagataagtacatagtcttacgaatcagacatccgactttggttcttagctctctctcttactatctgtaggaactagggcaacgctccagcatttctatataaagggacttaggggcagctatctggtagcaggacttttagtgttagaagctttgtttgcatagtaagcatgatgtttttacatggttatgtttttatttagaaaaattaagtgagaactgatggaaattattgggaaagaaagcacaaccatgctgtcccaccctgtactgcctctcccccgaccttgacatcacaactgagcaaactcttttacctttcatttctttaatttctataaaacagatatagttcttctgaccttacggagttgctataaggacaaaatagggtgataagtaaagtgattaacatagagcctgatatatagtaaatatagaaaatattaaaattatttatacattttcaatcaaaataagaataatgcaattctaaatcttcatatcaaatgattcatgttaaatgtgcttgctcaacatacaaaatataatacttgaataggctccaaaatctttattaattatatcagttattagaaaaagccacaattccaaaataaattcattccaggcattttatatttatcatggcttttgtaaacttagagatatagtaatgactgagtttatttttatttatttatttatttattttgagacagggtctcactgtgtcacccgctggagtgcagtggcatgatctgggctcactgcaatctctacctcccagaggttcaagtgatgttcccacctcagcctcccaagtagctgggaccacaggcacgtgccactacaccctgctaagaatttttttgtatttttttgtagagatagtcttactatgttgcccatgtggtcttgaactcctaggttcaagcggtcctcaactcagcctcccaaagtctggggattataggcgacagccatggcatctggccaatgcctgaatgtagaatctagtgggtacaaaattcgcctgatacatcagagctcagtccagcttttgaaatatgaagccaatcatactatctcaagtgtctttattgttcttataacattgtagtcattttgggacttaatttatggaatcattacattagttagttatgaaagccacctcaaaagtgtcactaatggagattcaatcaaagcttgaatggttaccagtctacatagagagatgattttgttctggctatctaaaatgagctatgagtgtgtttgtgtgtttttgtgcatgcccaaagacatttagatctgtatctatgtttgtatctgcaattatattattttcaattttaataattccagtttaatttggagtaataatactaataaaatatcaagtttaattgtagcttcctttatgaataaaactattcttccctttgaagagcatataaatatatagtaacaatgattaaaacctccagctttgaaggtagataatcttgggtccaaatttcaactgtgcctcttgttatgtgactttggacaagttcaggtacaataaatgcataataatacttattaaatgaggaagcaattcactctacccagtgcttcatagttaattaaggtctcaataattattagatatattttaacatcagtaattgctccgttatatcatagaatgatagattcttaattctgttcaattaaaaattatactaattagaaaatctcttaaaaataaattttcctaaaataatactttccttacatcaataatatctgtacaatgtaagagatatagctaaaaatatgaaattttaaaaatcatcaacccattaccattacaatttgagattatattcatatttacccaaaggtggtcaagacatttgactttcaaatcttctccctcctggagttccagcccaggacttgagactgagaaaatctgtatactttaataagaactaactaataaggcataaactaattaagatttactggcaaacatttttcaaatatgtctgtgtatgtgcttttaacatttcttgttttccattagatattcttctactctataatatcctatttaatgacatcttctggaagatcctagtgacagtgtagtgtagaattaatgccacaccattgtgcaacacaggtatttgtacactcacctttagcaattaaagctaacagctaacaagttcttacaaacagaaggtcctgctttaattagcagttaagatcttagaattatcaacattcatttacaagcaaacagtaaacgagcttaagttcttaaaacagttggctctgttaaatatattcactgagcggtttcacttgagcaattaatttgcaaagagaaaaaccaaaaccaaaaacttaagtgatcataaattttcaataaatatagttgaggtaagtgaggtgctattatttggtctgtgaaaatgaacagactacattaagtcttatgtaattttttcctggacttggtggatttcttcattggggatcactctgtgttttcaatcagaatgtgagatattctctagaaaaacaatcatttaaaattgtgcaaatttacaatttaaaattatgtctaaaatccatcttatgtttaatatctttctacttaggttgacaattgatgctgagtgccaattacaattgcacaactttccaatggatgaacactcctgccccttggagttctccagttgtaagtaatattccttctccatttgtatcctccctcacctacagtctttctgattgccatgttaattaattgaaagaagcataacaaatttcaaagttgtattaagttatgttactgacttcgatgattttgaccatctctttcatcttaatcccagcttgctccgattagggtgattcctgcaaaagaagggctgattttattaagaattacaataggtttccttgagttgcaaacttttaatatattggttgcatagagccttttttttttttgtaagggattgtaaagccaaccctggactcaatagaaaaggtgcaatctttaattatatatcctcttcctttctctcctatgggcctaggaagggactatagcagcacattgctagttaaggcctgccccacaggacaattatttcattgataaaatatatgtgaactactacttgacacacataagatcaaatataaaaccattatttttacatttattatttttatcagatagataatagaatgtagcaagaggatccatgatgatctaacacagattatgctttagtaacctttacaaatatttcctgcctgaatcaaagccaagcaaacctaaatttcccaaaacattttccttactatttgttcagcatccatgaaaggtcaattgcttcttttacattttttgtctgccagttgtacatattggacagaataaaaatctgattatagattttaaaagtatgtttgtagaaatgtaatttctcaaccagggagtccaccaagtcatagtaatcacagtttgaaaaacgttgatgatcagagaagtaatcacctgtttatcacttcatcaataccagaggaaaccagaggaaaaatatcactggacatcatatttacctagaaaaattctcattataaaacttatttcatgttttcctgaatccaagaatgaaatatatttaattataaagttaaagcttccctgtgctttagagagataagccttcctttcttttaatactccaattgggactacttctttcttgcgtcagctaaaattcaagaactgttgatttctctgccatcaggtggccagttgaaaatgatcctctgaacccaaacacaatttaatattactcattgctatcagaataattcagtcaccagcacattctctgcctcatatcatcatttttgttgttgttgttgttgttttgttttgttttgttttggacagggtctcgttctattgcccaggctggaatgtgcagtggtgtgatctcggctcactacagccttcgcttctggggctcaactgatcctcccaccttggcctccagagtagctgggatttcaggcacgcaccaccatacccagctaatttctgtattttttgtagagatggggcgtcgccatgttgcccaagctggatattatcactgttttcctcaattttcatcacatactatcatatctctctccatcccctccatcccttctagggactctctcttttttttcctccctctttaattaatataaacatataatagataaagctgcatcaaaaggaacagaaagggggaactatgtgggattttattccaagtactcaatcagtgttcataatcaaactaatctttacatggcattattatttattatcacataataattagtattattagtagacaaactgttaaaatgatttctgatttttatttattttcttgaaaaagttaattctgcagttgacttcataataatgtttatccattcaacaaatatacattgaccatcaattctgtgagataagtactattatcctccctataagaggacaaacaatttaggaggaaaaatatacacttgtccagggtagaatggctgggaaatggtactcataaccactactttatctcacctccccagtgtgatgtcttcaatgaatactctctgttctattagtacaagctcattgatatcttcctcttagcatttctacttactactgctttgaattgtgtatttctgtgtatattaaaatggagtcccaacaaattgagaaagaaagataataaataatttaggttacgttttccaactatcttccacttcaaatgcattctttggagaagttttgagtctgtactgtcttattattttctgtttctatgtgactcaaaatcttgctctgttaactgcctttcactgtgatacaagactttgtatttctactatttattatagactggtcacttggtatgcactattccagatgatgtaaagtatgcatatggcatatataaaatcacatgtagtataccttctatgtcatttaaattattttcaagagtaaatttgacctttggatttttgaatctaacttcccattaggatgcaaagtcattgcaatttatgttctcattgcaatgccctttggtccaagatcctcatttagcttgtaactatctttctcagtctttacctcagtgtcatgttcatagaagatggttgctacatatgctaatttataatcatttttaatgtgagctttcctatctcacggcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggtaagatgcactggcaaagaatttcaagtgacccttccagagttgaaattttggtatatatgaattagaagatttttcaatacctctcaatgaatgataatcagaaaattaaatgaagtgttttaactttctagagaaaattataattgaaattcaagtagaatagataaatataaatatattctaccaatatgggaaaattggattcaaattggattagtaaattattccctaatttatttaaggaaaaatgaatataattatgaaaaaataaaatatttattagatgtacctgttttagaaagtatgtttcataatgtagtgaaatcgccacatttcacacaggaagagtgaattttttacaaatgcagaaaagtaagcatagtggatatggacccattctccattcagtagtttaatattttaatcttatccatcagtggataatagaacaagccttgagtatcagacaggattgggttcaaattccaattgcatcagttataagctatagacattgggcaaatgtattgaatctctgagatcagcttttccagatacctaatgtgcattaaaaaaaattgcatcacaggaagacagtgtgtatgcaaaatataaatgaaatgaaatgcttagaatgatagctggcacatagtgagcacttggtcattagtagctcttactaatattaattatgattatcagatgtgcatgataatatggtcaggaattgagatttaagacaagctaaaagtaaatatttttatattaaatctcatgatttgtaatagttatcaattgttgatttaaaaccctctgtcgggcaagttagatatgtttccagaccagatatgtttctgtctcatgggtggccagtttgaactctcagcaatgttgcttatatcctctatgtagattaatccaactactctttttaaaattatgttaatttacatatgttcgaatttcaaatacaaacattgtgttctcagcttaccatctattaagatgtcatttgaagcatatttccaagagttgaggtgtttgctgttgatttagtcacaaacacctgattattttctagaattcataggaaatattttttgcgtatggaataatttggaatcaggccttcatctactttacagagagaagcaaataaaggacctacacaaagatggaaatttatgattcgattctactttcaaaagtaccatccttcaaatcaaagaattatctggctgtaacattgttttgagcatttgcaactgtctcctaaaggttcttttatttggaaaaaagaatctgaaagaaggtcatagtaatgcttgagtatattattttaaaatggccttctgttccattatttgcaagaaacctgaccatcaagtattagtagaacaatctttttttttttttttgagaaggagtctcgctctgtctcccaggctggagtgcagtggcgagatctctgctcactgcaagctctgcctcccgagttcatgccattctcctgcctcagcctccccagtagctgggactacaggcgcccaccaccacgcctggctaattttttgtattttttagtagagacgtggtttcaccttgttagccaggatggtctcgatctcctgaccttgtgatccgcctgcctcagcctctcaaactgctgggattacaggcaagagccaccgcgcccggcctagaacaatctttcatctggttcaaaaaggaaaagttcaggattgccttagaactgaagtcttccattggcgaaagaaaacacatacacacacacacacacacacacacacacaccacgtaaaattaatctccagttcttcatgcttccagaatgagaaattgggcattaagttctgttgtatattcatatttctataattattccagcactctaaaacagaacccacaaactcgtgactagaagatttcttgtttagttgttttgagcccaagagtggtatgaagaactaatggtggagacagaagggttgattttacatcacagagcccaacattaccacctccccaatgtctcgtgtggaggatgatctagggaatttactatctattaggagacacttgtgggagaaaattatctacttactttaagcatagcaaaaataattaacaaggtctcacaaggctattaatcttcctaaggaaatcacagcaaaacagtattgaaaagatactacatttcacactgagtaccatcatgtaactgatctcatcaactcctttgtgcatcctaatattgtgaatagccttcacagttggccttctctcccactcctcaccctgctggtttgtattttgtgtgtagtactatttcaacgggctcggtgacgagaaagggctgaattgaacattagtgttgataacgaaaggcaggctgatttctgtgacagctgatttttttaatgattggaagtttttgctcgatatttgcttgatttttgatgctattcttatcttcaaagcatagctgtgtaactaatgaatgtctacaaggaagttatgtttacaagtttcttgggaaattatcaggagatcaatcttagccaattataatgtgactttcttttagacttgtggtaaatgtatctccctttaagatgcctcttttgtaactgggggagaatattgccaaattgccacatagcttagtgaaggattttccaacctttattcattcaagctttgttatatccaagtagtgactgtacttctgattcctaatttttttctttaaattgattcatgtgggtttttttcttgaatgcgtaatgaattttattattttgttttaacttttaagttagggggtacatgtacaggtttgttatacaggcaaacttgtgtcttgggtggggggttgttgtatggattattttgtcacccaggtattgagccaagtacctcttagttatttttcctgatcctctccttcctcccaacctctgccttcccaaagacctcagtgtctgttgttcccttctatatgtccatgtattatcatcatttagcccccacttacaagtgagaacatgcagtatttggttttcttgtcctgtatcagcttgataggggtagtggcttccaactccatccatgttcttgcaaagaacatgttctcattttgtgtggctgcatagtattccttgatacatggttttttaatgaagttaattttttaaaggaaagttaatataaggaccataattggaaaaccaggacatttaacaaaaatacaagtgatataaaaatatgattaaaaaacaagtgaatactcttacactttaagtgcatatatttgtgttccctagactttgaatatgttgaaaaagagagagagagaaaaggatattagagcttgagtaaagagcaattagtaccaaatccagacattctctttgatataaacagaagaatagaagcatttcatatgagagaatttgctcaccaggaaatttaatgctatgtgagagtccttgcatccaccacctgaatcatctcctttattactactttatttgtactacagctgagaaaaatatttcccctgtggtgggtcgataagatttgaagaatatttttaattcattgtcaatatgctagaacagattctggatccatgatttcttcttcaaactataattccttcctgattgttctatatctggtagaagaacaaccattgccccagtgagccaggcgtgaacactcagagtcatgtctctgcctcccacatctaatgaatcatgaaggcacttatgcttctgaaatatcttgtgtaactgtcctcttttcagttgccattgccactgtcctagttcatgattttgtctgttctcatctggaatgtgtcagtagcttattaagttatgtgcctgctgtcaatttctctctcatctccagtctatgcctttcaccttaattataaaagctagcacttactaagcactaactacatgcaccatagcaagcactatgtgtaaatgatctgctttctcataaccatagttaacatttactattaacacagatggtatcactgcagatgagaaaattgagactttgaggggttcattttcctgcagaaatcaagggcaagcactgggacagaaactcaagtggtctgctctgacattcatactcttaatcacaacactatttgactcccatcatggcccagtgagctgatatatcccttcatcatgtctcaataattcagtaggttcaattgagcacaagctattgtttctagtatataagaatctggtctcaggaactttccagtcttgttttctacaatttcccagcttgtgaaagaaccgaactattaatatgtttctgtgtttaactaaccagtcttacactcacattgaatctcaatctctttctgttttgaatgacttcttaatgcatcactaccatctcatctctatgactttaaggcttaaatcagtggcatctcttcaacagtgcctttgctgatcttaataccaaaacaacttgaagcgatttttaagaatgttcaccacgggagtcagacagctcaggttttaacaccagctttgccatttactagtggtgtgactttatataaatcatttaatatatccgagcccaatatcaccagtatcaacagggttgctccaaggattaagaaacatactacattaaaaatctgcctgacaagtgggaaggacttggcaaatggaaggcaacaatattactgttattatcactatcattattattccattaactcctccaagagcattttcacccaccttaagaaaacatgatttctatgtgccacattttcttaatccagtctatcattgttggacatttgggttggttccaagtctttgctattgtgagtagtgccacaataaacatacatgtgcatgtgtctttatagcagcatgatttatatttctttgggtatatacccagtaatgggatggctgggcacatatacaccatggaatactatgcagccataaaaaatgatgagtttatgtcctttgtagggacatggatgaagctggaaaccatcattctcagcaaactatctcaaagacaaaaaatcaaacaccgcatgttctccctcataggtgggaattgaacaatgagaacacttggacacaggaaggggaacatcacacactggggcctgttgtggggtgggggtaggggagagggatagcattaggaaatatacctaatgtaaatgacgagttaatgggtgcagcacaccaacatgacacttgtatacatatgtaacaaacctgcacgttgtgcacatgtaccctagaacttaaagtataatatatatatatatatatatatatatatatatatttatttatataaaatgaaaacatgatttctgccttgtgttgcctgggcacttgctttactcctcagtccctgaccccttactccactacataagcttcacaacagaaaccttcttttaatcatctctaagccagtcaccagactaatagtcataatggactattaacctggtggctgacttaaaggtgattatagataatggtggtattaatcacttgtgacaattacattgatacaacagtatatcattcatcaatgaaatacataatgtggaatgctattatatatattttccattgctcattgtgttctctaagctagaagagattattctttttgtcatgttgccacggccagctcatcaaattctatccataatttttgactcttttttcttctctgttgtcatcctgagatgtgggctagaaaagtggacaaatgggtttcttacgggaaacttacattggtgggatcctcctgccatcataacgaatcacaaggaaatataccacatttctcccaaatcagaataccattaaatctgtcatattgtctttagcaatgcatccaaaacaccaaggtttcatgaaacatcttcataattatttctggcataaccatgtaaattattttctgtttttgttgtttttaatcccagttttttcttagattccatgttctagttatattttcctgatttgtatcacaaggaatatataactaggaaaatgaaaaatctgtgtaccactaaatttatcttcctttccaccagtgacatgcagatcacaatttcaaaacatcagctccatggatgaagttcatgcttgttgcctgatttctaaagtatacatatactgtatctttacgtgttgggcatcattctcccatcatactgttcccttccctgagattttcttactatgttacacctatcccaaagtctctgctcctatttattttattatttaataccaagttcaagtccaaccttctctgtctacatcaatgtttacatatgaataaaatgcttcctgaaatagagaacaatagcttccaccttttaggctgttttaatttaaatgtccttggtaaggagacatgcgtaaaacttgactcacgatttagatgatatattttggcagaaaaaaaggaaagttaaaaagctacaagttaatggtactttttaaattgaagaggttggaagggaaacaacaacaacaacaacaacaacaacaaaaactaaatgaaaataaaacctaaatgaaaaaagagaaataaacaactacagcaccaatcctacagtctcttgttactcctgagtctcagtgagttgtgagcctatttttagtcaatactaaatttttcaaactacttgaagcagcgtaatatcttaaaataaaccagtggatgattgcacagtaatagattttaattttatttttaagcttcaatttagaaagttagctttggtctcaggagagaaaagtgtatgaattatgtaaatagagctgggcctagagcagccatggggaagtcactttccctccttgggatgaaagttccttatctataaaaggagtacatttgattagatgcttctctaaagtcctcgtcctcagtatttattcataatccctgatataaccaaggttacactgtcaatatcctaatctaagagccactttctttataaatgaatatttttctagaatgtttttccttgatcaagttttcaataaaatttcaaaacaaatacaaaaacatactgcttggggtttaggtttttaatttagaggaagcagttttcccccctatctattttgttcttagtgatatgttattatacacattaaacaaaaatgttaaccaaaaatgataacctattttctttccattgtgattctggaacatttgtatgctgtgttaaaaatcacacatttggattttaaattccaaggttgtgttcacactatctagcagggagatagtttttaaggggcggagggagatggcatagagaagttctgtgaaatcaaaggaaaattgtctggtttcaaggtgacacatgtcatttctgcttatgttccattggcgagaactagttgcatattcccatagagatgaactgaggttgggaaatgtagctcaattttgggttaggaaaggacaatggattttatgactttctagcatctatgcaatatacacaatggtattttatttctcacaagaagcttctgagaaagatattctttttccatttgatagatgaggaaactaaggtttagatgggctaagttatttgttcaaggatattcaatgggtagagttatttattcagatccacaatttttactccataaagaaatgaattaaaataaaaactattcctaagcttgattatagctatttttacagagacatgcaacaatgaagtattagcacttaatatggtagccatatatatgaatcaacaatatgttaacctgtaggaataccaattatctttagatacagcaaaagtataaagtgagaaacttaatttagcaattatatcgtttcatttttcataaaagttatttactgcttatgagatagtattatttactagttaagtggtcattactactcacaagttaagtggatctgcacaagaccattcaaatctgactgtaattcaaaaattgttgaatccagtgtatttgtgaaaacttgttctttgaaaaaaatcaatttgagagaatatataatgaaaggtttgcatgactactatttacgataaattttaagattaatatttttgacagtctatcaaaaccaaccagatcaaaaaagcatttttttttttaatccaagttgttggtattttctaacccagctgaaaatcctattttgctacatttaagagacatttacatcagtgtgactgatataactaatagatctctaataaacagctactgccccaaaataaatttgaaagacattttttttttgaaaatgcaaaaatgtgagagaatgaagactgagccttcagagatgatactctacacataaactaattgaagattacttttaccctatttgatgtaagtgaatgattccttcatcttattcttgcagtttcagaaaataatgctattcagcattgcagatacgcacttttaagcatatcacagactggaaatgggcagcaaatagcaataaggaaaatgtattctttttaaaatattttaccttcttttctttaaaaggagatttttatgaaggccacaacattgtgttgcacaacattctagaaaagaatttgctgggcatacagattaggggctgactagagtttatttaccattttcacctgccattcatgtaatacatttcatttaagagatcaagaacatctaattttagtagtacatccagcaaaacagaaacagatagtaaaaccccaaggaaaaaggattgaccaatatgttaaacatggtttacaatgtcacttttttgtttgcttttattttttattttattttattattattattattttgagacagagtctcgctctgttacccaggccggagtgcagtggtgagatctcgactcatgcaacctccacctcccagttcgtgcctcagcctcccaagtagctgggattgcacacgcacgccactatgcctggctaatttttgtatttttaatagagacggggtttcaccatgttggccagtttggtctcaagctcccgacctcaggtgatacatctgcctaggcctcccaaagttctggggttacaagcatgagccaccatgcccagcctggtttgtttttgtataagggtatctctgctgttcaagaaattcacagtgctttacagttaacatagaaaaacacatcatagatgtctaatttttcacatttctctgttttccaatttatccactccaaaattaactactcttttcagtgcaccatgttccacaatgatgacaagaagatatactaaaaagttctattctcttaaaattagttcttcttccatgcccactacaaacctaattgttttgcccataagcacttcactagcagctttataagatgatatctttctttagaaacactggagtacaataaataagttacattgccaacaagactcaaagatgaaagcttcagtttagacaagtgagtttactggattagtttccaaacataatttgtaatctgcctatactcacatgactaatagcaccatgtaccaatgatatactttcatcattacatctattgttcattgctaagtggtgaagagttatgtagtatcaaagacaatgtgtaattcacaaactgtgtaacggttccttgttaaagaggtaatgcaatcatggacaccaattgtaatcgcctactgatcacatttccttatgggtggtttcttgttaccagtattagtgactaagagtgaagtagaattggtataaaaataaaattttagggctaaatcttaaagaccaagcccagttgtaatttcacttacagggaaattactccaaagaggtaaagtcagagcttctgaattttgacagcccattatttgactcctgcctatagcagggtctttaggatggacagagttaaatttcattttatttctcaactaataataaacaactgataattttcatgggaaatttaaaagattcttatatcctaaacatctgagaaagccctcattcccatgtaaaaataattatgtagagctgaattatcacctgtctcaacatgtgggtaatacaatctccagtttaccaaagtctctactactccctgtcctatttcctatttttggagttatgttttcttcttgagttactgttttcatattttggaaagcaatgtgtaggtgtatcgctataaaaatggggaaaattagagataattaatatgagatagcatatgtatctgtagagatgaaaaatattattttatcttttaaaataaaagataatgggaggctgaggcaggagaatcgcttgaacccaggaggcagaggttgtggtgagccgagatagcaccatttgcaccccagcctaggcaacaagagcgaaattctgtctcaaaaataaataaataaataagataaataaagggcaaagaggatttttctatcacaaaatgacactctaaaaaatgaatgctaaaactatgacttaaccaaagtttgcctgaaaataaagattaggtgaattgcaaagaagtgccagaattttgtcaatctagatctcaccttttgacattctgcaactgggcttatgtatcataaatatctaacataagcaatgttaagttcattcagtttatctctactgtccactttcatggaagatggattttgaataaaaataaaattgcaaagttctatatatggacatctgtgcctgtagtcttcaccgtcttttagtttcttttccaactcacatgtaagcagctaaaagctttgttgccgtttttggtttgttgccgttttgctttgttgtcgttttgctttgttgccattgtcttgcacattagcagtcttgcattgtcaatcaaactgatactttgtccctttgtagttttctgaagatctacatagttaatgttctgcaataaaatcctattctttacttactttgataaaatgaggcagctgtgtatagagctctgcataccctatgattcccatttaaaggtttccattttggttgtggtatcatgtagctgaatgaccttaaggaagtcattttctctttgaacctgcaatttcttcatctcaaaacaaataaaaatcagactagactgattttgaaggtttacttcactcctgaaacactgtgtcatatttcctggtatttaacatctctgttacgaagcaaacatatggtgggtatttgcgttctctatgtcccctagaattcctaacaaaacttttatcatgttttcttattatgtcacattcagaaattaacagatttactttgtctgtcccgtgtggagatcttaggtgagggaaggggaccagggtgttgccatagagatggttgataagttagctaaggtctgataaaatgaattcagcatggaaacatagacctgccatgagtgggaggagcaagggtggatgctaactgaaattactgtgaatgagaaattggggatggggtgaaggtaggacagtggctgtgacatggctttcagagaggaaggaaaagatactcaggtcttcaaacaggaagaagatttgccatcaagagtgcataaaaggaccttaatttattagcctattattttgtttttaatatcttaattgtataaattggctgaacttgtatagtcctgtgagtcggcagtcaaaataataatgacaccactacctctaaaataataatgataatgataataatgacaatatgtgctaacattgtgaagcactttctatacatcagctcattcatttttcacagccattccataatatgatgctcattttccagatgaaatttccaggtacaaccaaccttgtagaaaagttgacagagagggtaagaaccttgtgcaatatcatggtgtaagttactgaatagacactcatctttcctgactgacagtctgattccaattatgaattaaacaccaaggggtgtgcgtgcatgtgtgtgtgtgtgtgtgtgtgtgtgtgtgtgtgtgtttccagaaaggattactcttggccctatttctttatctagtgtgtaatttatgttcctgttattgttttggcatctatccatctaccaatctatctatctatctaatctatcctttatctatttatcttaagctgattgcatataagtatggtagagtcagtctgtattggtcagcttaatctagacaatgctatggtaacaaataaccctcaaaatctcagtggattaaagtaagaacaatctcaattgttctacctccagtgtttctttattctgtggtatatcattctcatagccaaaaggggaaataatagaagagtaaaattgtccttaaaacctctgctttgtgggtcttaagtaattttgactcacattctactgaccaaagcaaatcccaagaacaagcctgatgtccatggaataagatgcacaatgctttcacacaaaggggcaccagggaaggcctctatagggatggactttgtaggcaggggaagcaaatatctggattacaaaactgtcaccaacaattaacaatagtataatcctttatactatacatgactcacctacctggccatgtcggaggggcccagtcaccagatctcatggagtcttctctagaagtagtggggcaggcaatactctgtgacatttaattctgcaatatgggaccataactttgacaaagaccttagggaggttgaaaggaattcctaatcacgtgaatggggaatagagtcccaggcttgtgatttgccagttttggtttctgttggttttcagatcccaagatcatgtgccaggataagttacttttaaaaagagaaaggaataccatactctcagagaaaatactgcccaagaatgaaaatgtctgtctgagaattatcctctcaaaaagagattgttttgggtcaagactgtctcactctgtcagtgacctatagcatgatttctaatttatgtaaaattggtttcagaagagcaggtgagaacacatgatattaacatgaaaatgattgtagggtgatgggaacagtcatattttataaacataagcaaaattttctttgttgtactgctgggacagctttattaattacaagtccaaaatattggtcctgtactaaattcaattttacagttattattcggtgttaacttctaagaagcgataaaccagaatcatctccttgtcagtaggaggaagtaattgaaaatgatttaataaagaatggctacaaaataatgtaaaggtcacattgtcttgattgttattattcttttcatggaaaaaaaaaatccttaatgtctctaacagtcctgtgtaagaggaagatattgtcaaaaagagtagtttcaagcaacttttaaaatcttttcctgtatttaatcttaacaattgagctacgatttaaccttttctttaatgaagcattcttaattttgttcctctgttttatagataaagtacatgaagcatagtgctaacaataatttaaaatattgccatatggctagttatgagtagaactaaagctaattaacaagtgtaggggaccccaagcaactgttctctcctctacccaagactgaattagtacaaaacagaattgccatttcattggttgacattgaataattgagtactaatagatattttggtcctaaaaatctgccactgttaatatatgcacagataagtagtgttggtaatgatatggtgatgataatgatgatgatgatgacgcagatgctaaagccaacttttgttgagcatttcacatatgaaagacaccgtgttacgcgcttcactagaactgtaaacttgcgacaaatttttgcaggtttttgaattatggattcaaatcctgagccagtatttgattttagactcagccccagaatttttgttgagtcttatttgtaggtagtggtgatttggtatagcagttttgtttattttttctcctcaactctttttctgccatccatggtagttttatcaaggaaaaaaaaacccaaactattgctgttcatagaggttctgatggtgtgtgtgtgtgtgtgtgtgtgtgtgtgtgtgtctgtaataaacataataaaaacacgtattttcaaggtactcatgccaattatatactgtaacagcctgataggttttattgtttgcagttaatggcaagagttttgataattaactctaacctaatatgtctagttttctttttatagaaacaagagtgaggtggtaacaggtgtatcttgatcaaggacatttaaaatccttcccataactggacatattatctctgtctcaaaggaaaactctgggtataattacataggtgctgtaatagcaaaactaggctagaagtaaaaagatctggctttaagtcccaggtaaacttataaacatgtgaatatatttgagcaaaactctctctatatatctatatctatatctatatctgtgccagtaagcaaattgacacatgaaataaatgaatcatttctcccaactccacaaggaacaaggctgagattgtgactcaagttcctacttctcactcctgggttcctgtgatcagattttgtcatcgggacttaagaaggatgacaagctgataacaatctagggtattattaaagcgacacaaaaggcaaaattctgacttttctgcaactttggtggaaaattgctattaaaagatgaaggctaaatgtggaaaggaaaggataaagaatgctatactcagaggaagacagaggaaggtcgtattgggatggcccctaggattaatgcactttaacgtaaagtgaaaaagggacttgtagcattggactgttttgaagtccccaggggcatttgagaatgctggacccagttaaatgcagtcctttaagtcatttgagaattgaaaattaaactttcagataaggaatataggatgaaagacaatttgaaattagactccacacagagatatagagaaatatttaagagaattatcctttcatattaaaacattcagtgcgttctcttgtctatatgtagggatgcaaggagaattacaaaactctgcattacctctagtctctattctgtctggggctgagagaaacaaatgcttatttcctcctgaaaactgataacctattttcaactttccaaatttctctccagataatttctgtttacttcaagagttcatagttacccaatgttgtaataattattaacatattttatttgttgaaaactactgtgtgcagcaaactacccatagcaattcatttatagtatatcataattctcttaagaactttgaagtagatatatgatcactaccctccttttagagataagtttcttgattatttattctgggcctcccatgttcccaaatagggttcaagaaggtaaattttccttgagcagcccacagtccaatgaaatgacaatgatcgagatgtaactgaactttagataatttttatatgaatctctatgtgctgagactgatgaagcacctaccttacaccgaagtctatgctttttactacaacggagcacatcaatgcctacatgcttcaatagcatgtcattcccatttttatttttttctgaatgaagaaatcattgtcctaaatataccttaatttctcaaaataccttaggatatgtttggaatataatttgaaggtattggtatagtcataatgctgtttaagagctattgtagttcttaattgtgacggtttcaggggcttactttagcaagctgcctacttccacccactcctcttcctggcatttggaatgatcgcccccatgcttgccatgcctagtgcctctcagacagaggctggtgggagaaatgtatctgcagcgtccatctgccagctccatactgaaataactggggtttacttgagcagcctttgctgaaacctcagacagtggtaaaggtggtgtttccatagttgtgccaacttaacattaaatcaggtgctatatgttttatacttgcctttccctgtcttttacattcaatttttggcccatggaagtaccaggcacaacctttgcacccatacatctgtcatctgtctgtaattctagatatgatagtcatttgatgttgtgtccaacaattccatcttccctcattctctcaggggttctttctgaggcctaggagaatataatataatagatcacactcaaagggaatattaagctctttttgagattattactctagcattgaagtttcatgtctaaacctgaggttatgcctacttgaattctctgtacagtggagatattagagagttgcagttaggactcaagaactatagctttttcttgactattcatctttcaacataagatgtagacttgggaggattctggatgcagcatcagataatagagacggcatgtgagctctcatgccacctctgcaagctgcatgaactcaggcagtttctaatctaccttagccacagtttacatgcctataaatagaaaataagtgttcaatttctctgaccatataggatccttgcaattattaaatgagattaaagtatatgaaaatggctctgcaattgcaaagcactatataactttacaggaccatttaaactgaattatacaagaagagaactagccagtttagattaagaattcccattaaaacctggtagtaaaagccagcattgctttctttaaccaagatattattcaattagatactttgttcattatttgtttagtatttgctgagcacatattgtatataaaagactgtatcaagggatatcaggttcaaagttaaacaaggcaaggattccagtgttaataagtttaaattcttacttattcatgcgaatcattataaactgtagaagctctacgctttttactgaaacctccctctgtcaaaagtatggaccaatgtctgtggcaatttgaagagtagatgctcgtgagtcattccattgcatgtccacatacttctgctgagtttaatattcatctagagtcagttgtgtttctgtccaaacctgttaatgaatgttgaactattatttcaatgatacaatttaaatattacataaggctatataattaggtgtgagctaattatttgtaaatgcttataaaacagtgcatattagaaagaatgtttacacttgatctttttaaaattgatgaatttgagtgtgatttgtatatgaatgatgacacttggataaccagttggcagactctagttcaaagcaaaggagctttggatctattttttttaaatggtggacaaagtgtgcattttgtagatttttagttaaaatgcattttgaaacattgtataaattatattcattaataacttataaaagactccttttcaccaactgacctagtacaagctctttttgtatttgataagaaggtttctcctttataagactgactgtagatataatgccatgaacatccaattttatgtttatctccttagcaactagcttagtgcctggcacatagtaggtgctttttaaagacatgctggagttgaaggaggtaactagaagaaagatcatgaagtggaagcatttgaaatgaatcttgcaaatagggagaaattgggtttgatagtgttgtggacagaacagaaagagcatcaatgtgtcctcttaagatcacgggattatcatttaatgtaattgaaggcatttgaatttctatatctataaaatgtagaatagctagcagtcaaagggtcatatagaaactatgcatgcataaataaatcagtgctgtcattaactttccaatatcttagtgtcactgaaggcaaaagtcaggtttaaaaacattcttaactttaaattacataagaagcataagaaaatttgtgaaattggaagagttccagacatatatttcttaattcctctagaatacacacaaacacataaaaataaatgcttactttaaaatttgacaagatatatatttatgtaacttgaactaattttaaattatttagaaccaaaataaaagttgcattggctaaacagcgaggaagttgaatacttaaacgcaattcatagaacctatatcctaataactatgagttaggcctctgctgcggtgttgcacctattaaaagcaaatcaaaacaagccaaaaataaacaaattggacaaatgaaaacacacatatacaaattttaaaacagacaaaaataactgaatacatttaaaaaattaaatgattatagaatttacttccactgagtatattaaaagaatagataatctatataaaccgttcgttacacatattattgaagggttccatcactagtattgagacattcaggaatagtctgttttatacttcagattatttaatgttttttatcttcatgacagaccacccattatatttcaattgtcttgaaatataattttaaaaagagagaaaagatgaaagatcaaataaagcaaaaaagaaagactttcacaaagatatctctagataaatggcttcatcagtaaatatatttaaacattaaagaaaaatagtattcttatacaaactacttgagaatggaaaagatagagcatgaattttgagcccattaaaacctaacataatagtcaaagactttgtaaagcaaataagaaaataaaaaaagaaggaaggaaaggaaagaaaagaaaacattaaaattaccttattttgttgattcttgtttatgtttatttttcattttaatatctctaaaatttagacatttaagaataaatgctataatatcttgcactatatatctgggagtagcttctggcacagtcaagaaagtaccaatatgaaaacagcttagaatatattcaacatgaaaatcattgtatatttgaaaacaaagtgtttaatgataattaaaagatgactaaatgttttaatattctataaagagttaactaatcatatctgagaaaaaagaagggatagatattatttgttttctatcaataaaatctgtaaatcatcctcctgatatttttttttctaatttctatttcttcacacttcaaacattaaaagtcaaagatgcatttgtttggaattagtcatggataagatataatcatctttattggactctaataatgttctaggcatatgaaacctttatttatctaattatctaattatttttgcatgatgatggtattgtcataccacacatctatatttaaacaaattttcatatggaacttgataagcattaaccaataaaaaataattatgcattctcaaaacaaataaaaaaatttagttgagctcaacctgtcttgggagttacagcaaaaagaaaaaagtaacatacttgtgtaagtgtgtgtctgtttacatataatcacatgtatatttttaaagactgacagtagcttcttttcattgggtatttactatgtgtcaggatctgagctaagtgttttatggcattactctattaatcattgtagtagctatgaggacttgtgttattattattctataggagagaagcagatttagagaagttaagaaatgtaccagtgggtcacatagtgtgtagcaaagccaagacttgtaaatgggcctgtctacctccaaagaatgtgtccataaccactgtgttaatgtttttgtttgtgtgtgaaacatttaaaataattataactatagaagcaacatcttcaaacgactggtcatcaggaaatctggaagaaaagtgattctcttttatccatataagcaaaatgcagcaatgaatgatgaatcaaggtgaggaataactagggttaaagcaatgctcagtagagggcctgagaggcatgaggaaataaagaagcttccccagagagaaagtgtttgagctgggtcttatcatgagatttcaaatagctaaagagaaaaaaggggcatttaggccaggatagtagtataaataaaggctatatggcggaatgaccaagtgttttcaagtgattgtgaatgtttttgtttaagagtccaattggcaacaccatcttcttgcctcccatgttctaaaacaatagaaaaatacaacaaataaagtgagtagaaagtgaccaaagcatcatcttttttactgatattcctgatattgaaacattttgcatatacctatgagagaaattgctttataatattaaactccagaactagaattacctatctagcagaatcagaattactcacccctagaaaaacagcatagaataggtatgccctttagagaggccctcccgagaaaaaggaataggaaggaatgcggcaatgcacattcagttttgttttgttttgttttttgattttgtttgtttgtttgtttgttttcctccagggtggagttaaaggacagagagaggctggtagtgttattctaatgaagttccttcacagggaaggaaacatgaggagtgaagaaaaagcatccctccacctaggccagacttgaaaatctgcatttagaatctcaaaaaagcactatttcttaatgcgccgcatgacacacagtgctagagatccagtcctttatacctagctctttctaaatattcctaatagctaataaatagaagaattgaaatacgcttctgcaaaatgatgcaaggaatctcataagtcaccaagaaagggcattacctacacataagagcagtctcaaaataaataagatgcagtttttgctgttctttctggtataaagagatgtgtgtgtgtgtgtgtgtgtgtgtgtgtgtgtgtgtatttgcaactaagcatatcaaaaacagaatagaatgaaaggtttctcagcttagatgatgtctctttgaccatacctcaactgtcttcaatagttcttataattatgtcggaaaaaataaaaccctgggacaaatatgctatattctgagaaaacagaaactttcactttctggtagagaaacaactagataaatctattgcctatttttttctcttaatttccaacatttatatatatatttatttccagttgaatcattgagcaaactctgtttggtgcgagtgttctttttaatcttctggatattcatttttaccctgttgcttgctcatctatcctttctgtagtgtctgattttaatatacgttttaaaattttatcatgaaatataatcaaagagtgtctggattctagtggctaagtcatttcccaccaagattttggattatataatcattgaggtctcaacgcaaatgtagatagcagcttcactttaaggcatgatgcataaggtttgaggtcttgtgccatttttgatagttaggattcccagtttttaaacactacttgttaattgctgaaaagttattaaggcaagaagacacgtcagttgtccaaagaacagcaagaagttcaggttggttgagagtaggcatcaagcagaagaaaattttggtttaatcaaagtggtggtttgtcagatgaacgtaataaaagacaggagaattgagggagtggttgtaatgaccaaccaaaaaacttacacagagtaaggaaggagagaccactgaggggatgagggaaggttataaggtcatagaatcaatagacaaaggtctccataaagtaaaaagatttggaatgctagagtataagagtataagaggggcttaactggaaacaaataagagatgttgttccatagtaagattcatgaaatagatattatggaaaggttacagttattaatttaaaaatagtaatgtcttgagtatgccattgaagagggtgaatgaaatagtatggaggtcaacctcatacaccatccatctagagaaatttaagaaacttagaagacagagatttgtgggtcatatttttgaaacctcaagaattaatacgaaagatgtggagtatgtgatagtgagccagtagttaaaatcttcaagaaatgagggggtaatgacatttcatattaagattagacatggtagattcaagtcagctagtgttggtgcagctattgagagtatgactgaagaagtcgtacttgtgatttcatcttcacccctacagatgaggaaaggcattctagaggattggatgtttatcacagtgtgcaatccagtgttccacccaccagtgggtccctgataaatggaaaagcctatggaaatcattgtcctagagtagtgtgtgaactcacttttgacctctattgtggggggatggaattatattaagtgtgagactccacttgacatctttagatagagttaaaactttgggaaaggcagatgttatcccagcatgaggtttccctctgcacaccaaaggtggtagatggcctaggaaatgcttcacatcgtccccaggagtaattccaaataccttagcatgacatacatgacacttcacactcaattctccgagcccatctttctccaccttccccttcacctaattctggcagtcaacattatagccacatgaactgtttgtagtttttcaaataactcaggctgccacatgcccgagggacttttcacttgtttcctctccctgaaacgttcttcacttgaaaactcctgtatgtccttgaagtctctcattgtacatgcaaggcactttgcaatctggaactctcttatttatcctgtatctacatttcctaccactgggagtggcttatagcagatgatcaacaaactctggttgttataagttcatttaatttcccatagtaattaatcatcctgaacatttttaaatttacaattagaaaattccagaggtaatttccaggcaccattacctctgcaaacctaccatcattagaattcaaccgtggcactcttaaggatgaaaagaaagataataaaagtcttaagtacagacacgtaagtaatggagattaagatagcaggattgccggaagctcataactcttgttaagaatttttaaagcaaagttatcaaatctctgcacagtggaaaacctatgtgttttgaatataaatgtagtttttttcatgaaaatcatcttttcactagtgcctgtactttagatatttgtggctaatggcatttccccaaaattaaaagtatgctagaaaaaaactaagatcattctaggtttatattgggttgttctagtttgttttcttcatctaatcacctatatggtatgctctagtatatgactaaatctaagatttatgtaagattataaaatttggggtatctatatttgtatcatagttcaaccatcactggaagctcatatctccatatgtgagcaacactgagatagggtatttagggcagattagagattctgttttgtcaatgaatgaatgaatgacaatgaatttgagggctctggatatgatcctatcctcctatgcaccatgataccaaaaccccattattaaatatgttgtctcctgaattcaccgtattttgtcttcaggaatcccctccacaatgcaaatgcccaagaaaggtaatcattagacaactagtatattatgctttctatcagatcaatcaaaggaagggaatgcaacacaaaaagatttgagcatagacgtgaggaaactgacgatcgaaggatttcagtaacttaaagtcatacacttagtaagaaccagagtcagggtgtgaatccagatttgttctgaaaaccacatggacgtagtgagagcacagagtgctgctcagggtaaatggtctgtcaggtgccctgtgtgaagttatgcaggaggtggaaagcaaggctttggtcacatgggacagagagtatcaagagaccatttcccagagaaatggaaagcatgtgatatataaattcagtatttatcatgcttttatttcaaattattcagaagaagggaaactcctcttttcttttacctgctggcccaattttctgaataccctccctttcctggagatcacagaaggtggctgcacgccaagccaaacatctcttctgcttaagttttccccagtcctcttttctggctgagatacagtgaggaggtgtattgatttcagctcagattctcatctgggtcattcaacccgcattcagcaagtggcattctttcactgctggaggcagagagacactgtcagtctctccctggaggacagttgactaagtgtggtaagactgtttgctggcatcccttcccttgtctgggtttgttttacataacagcatgccacagctcttcaaggaacaatgctggaaatgcccctggcttcccttctcctgacatgtaggagggaaacatgagcatttgcaaaatgctgttgctccaaactcagctttcagcaggcagataataaatattcctccatgctgagctccttcctctcctctcctctccctcttctatcatatggttatctatgacagtgaagctctgatactgtacttcgactttttgaggaggcaggatgaaaagcaaggggcttcagtttcatcatttctaggatggaagaattgaagaagttggtatctaaatgtgcataattctgtggtcatggttatcctgttattatttcagtatcatggaccaaaatctctgtgcatgtcttttaatggaatgccattgtgagaaatttttaaattaagaatcaagcaactaaaattctacatctagatctggtactaattatgtgaccctgggtatataatttcaactctctgagtcgcagttacagctggattaggtgatccttgatattctttctaactgcaaatagtctattatatactttcttttttccagttggcatatcttttatttactttaaagtgatagtattttagagaaataattttagaactgaaaacacaggaagccttttcgaattttattagttgttgattggtgtattttcttaataagaacaatagccaaactggcataggaaagcaagaaagtttgtgatcaatgtttatgtcaccagaattttctttgcctttctacagaagataagctacatgaaatcttggtgaatttgacattgggtaaggttacagattttccacaaaagttgatacatggcaaacaagaaaagggagagtttgtttttctccttgttcagaacacaagtcttaaaacatcactaagggtatctttcttaacgtgaaaaagattaaaatgcaaacccaaacaaagaactgtaatacacaactagattctcaagattataagaccctatgagttacgtgaaaacatttaaaaagtgaaaaaaaaaatgatagtaacattcaataacatttgttaagcacccggtctgagtccttgtgctaaaacaccataggaatcatttatttaatccattcaacaaatctatgagatacagatgataattttttccattttcatctgcgaaaaaaacagaccggacaagtaaagtaacatttcttgctcaacattataaagcaaataaaggtcaaactaagaaataacaggttttttctaaatttttcatcaaatgttgtattccttaaatttcaaaaataaattttagagcttccactgttaaaatttgatacatatattacatatgtcaatttaaataacaacactatgaatttttaaatattaaaattatatttaatgtttacatagggttttcagagatctattatttaattgaatttgttataatttatagggaagagaaagagaattagagaagagatcggattcacccaagatcacacaaagtcacatataggcaggaattggaagctaggtctgctgactttgaatctagtactttgcccaccaacacagaaagtttcctttttcagagaagttgagctttttcgaaccaactctatatagtatggtaaagtgtacagaggttttaaaatatatattggcaatgatttttaacagatatcttaaaaatatccttgaatttcacaaaatgaaaaacttcctgggtgaaagaattccatgggggcaggggtgtgatagttgaaaatcgagtgcttgagaataaagagcaagtaaggtcaagtttttaaacctataattttgcagaatattcccaggagtgatttgacatcttggggaacattttgtgatttgaccttttgcaaccactgcctgcagttgcctgaatttgaacaattattttttttctagctgctttcaaagccattttagaaggcttggtattctgataacattaggtttctctacctctgtggagccttttctttaagaaaatgtcagtgcctgggttagattaatcaggtccggcttcaaatgcaaagttacccaggctcatcaaaagggtgaaaatgacaagaaaaataaagcgcttctactaatacgcttatttctccaaaataggtttctgggtttggcgttatatttattaatgacatttctctctttatctcttgattttgacccatttgtgagatagaattgtaaattgaagagatagtattcaaatatcatcttgattgcaggtaaccttggtttgtaggattcgtttttatttacagctgggattcttactttttctcctccaaggctaatatttggtatttaccagctcaagagagatgtggatgtggtagagcatacacttgcttggaatagctggctgacacccactgagtccccatagaaggcatggagagagaccatgaggtcatcatctaaacagtaatccatgccttgattcaagagagcttatcaaatgaaggacaagagcaaggaattatgagatccattcaataagaaaacacctaagtgatgaagtgtcttaatttcaccaaatagataaccaaaatgagtaaagtgagaggagaagcagtggaatcttttctttccaatacttctaaaagggtgtatatttctgttcacaggtcaggaaaaaatgagggaagacaaaggacattatgactcctaaagaggagtgtcccccacagcaagtccagctgaatatgtgtactatagactatagtaaatgtttcctaaaagcctagtttcgtgataatatatctttggaaaatgctaagttaaaggcaaacatcttctagtgcagaagcacatatgtgctaatgtgcgtggtgaacctccagtggtatcgcacgctgtttcacaaaaatcaaatgttcctgattgaagaagtcattatttttagcatattatgaaaccaatgttcaatgaaaaatattacttagaaacatcactttaagagtattcccaactatactcttcttctttctcctccactgtattctcttctttcttttttgtaatattttaaattctggtggttctcaaactttggtaggaatattaaacaaggaatgaaataagctatgagctgaaagaacaaaaatttgcaagatttataattattaaggattacaaattatttataaagactaaacttatatagaataaatatttataaagacttttaacatgcatactatcaatccacaagatagcatccatctgaatataatctgaatccacgtgccatgattcaaatgtcccccagtgttcgtactgcccttccaaactttgcagctgttaacttgttagaattattgaaaaataattggtaagccttggatttagggtcaaaatgtggtgagacacctactccaatattagtagctataaggaagttaccacaaatttgaatatgtgtatactagtcagtgaaatattctaatagtaaaacttaggttttgggtggcattcagagttcctagtagagccttcggcacctaggagaaaataaaaaatggtggtaattacaacaaatattgattaattacaaccagttattgcaacaggtattgcaagaactctgtcaggttgctatggagaattttgtcatctctattttacaaaataggaaactgagtctcagattggttacttaaaataacctcctaatatcacaaattagtttttgaccaatttgggacacgaacttggttcttactaaatatactgtcctgtttttataaattgatggataccaagcaatttttaaggagaacaagattctatctccagagtagatggaaaaagttgttccccgtggataaggcatctgtttttcaggacagacctgtggaccaggcatttttctgttgagaattctttgttctttcaacacatcacaaatagaatttctactcattttctctgtgaaatgcagtctcatcatttctatgtcagaagggcaaaatgtaacatatcaaccccaactctgtggctctgggattacaactctgacaaatcaattataatctcttactcaaaggagcatatctagcacttacctaactatatatggttgagtagaagtaaatgactgcaacatttctcagaatttatcaggtcttcactgacacctctgtagatcccattttctctattaaagctaattttctcatcaaagttaatagatgcaactagactattatatctgcttcttattggcacctctcttctgaagtgctgaaactatttccattgaaccatgagagctaagaatggaatatgaattcacattttaaaatttctcctgaaatgggacttctgcaaaaggtaaattagatctgttagtgtcacaaccatactctatacaaacattaagtacatataaaagaatattttgttaccttctgacaaaacctgttggtatgtaattagtctgttcctcagaaattgagttgaacaaaacagcataattttactaatgcaaatatgtgagctctaataatgtattactggctctaacagtgggtgactgtaatagtgtattactggctttcatggatgcattaatattagtagaaacaagcataagattggctactttactattactcctgaagcctgaaggtagccttttaacaaaggaaaaaaaaatcactcaacaggaatatcacctaccaatgtcacagaagttattcttcaaatcgactgtcctcaaaaagctctatgtaccactttttctatactctgtgttcgaaagatgacaaaacactttgcctactattagcaaatgtgtttctcacaatagccttagcaataagtttgtttattcctactttagtgggagaatttaaacaacttactcgcatttctgtaccttattatcatgattgcatgtgctttaatcctgggactagatctgctactgtgaattgccctgcgtttatgtaaaacatgttttaatatctagttagatgtttgcaggagttacagttaattataccaggaaattgctgtctctttcgatggatcaaagtagcaaatgtattcatttgtagctgtagttttagatttctgagctggagttgttttatttatgtatatcccaaggtgaacatatttgctgcatttttttgaacttgactatggactcagacaaatgaatagcattacaaaattccacattgggctaggcatctgtggtagcttttttggagggtgagaaagggaacctcttgcataaagagaattttctagtaaaggaaggcagaaaactgggatatcagcaaagacctagctccatgaacctagagaaaaccactacatttggaggctttgcaaatactgagctttctttcatctaaagctatccgccaagagaaaatgtctgcttttgttgaggcagaggcaggctggtattccagacaaatgagttttcagcttcctaaagctaatacgtgcattatataatgttcaagagtaaatgaaggctctgtttgtcattgagggccccagttatccaaaccagctttctatattaaccacattcttgacattcaacaattagtcagctttccacattgtttttgtttgttttctttggatttatcatcatagtcctaaccactgatttagaacacagaggctattttctacagaaggagtatgggtttataaggcaggattcttaggcctgccagtaggtagctctgtctctttggataaagcatccttctttgatgaacgtcaactgcttaatctttaagaggatagaattggttggtatagatttattctaagacactttctaactctcttttttgaatacttagtaagtttctcctatgtttattatgggtcagaacagtgtttaatcatatttcatagattactctgctttgacataactgacattaacgtaccatcctatgtgccaggaattgtaccaagaatggtatgtatattaactctttttatgttcacaatatcactgtgaagtggattctattattattcttactttacagataaagaagttgagactcagagacatagaaaagttgcctgaaatcacacaatcagttagtgacaggattcgaattttgaacccagttaatctgatatttgcccttgcagtggacactgttgatgcccctgccaccctatcacctttcttgaactcacacacccatctctcagatgcttaggggttggctgctgacagctcactacttgccactttttctagagaaataccactggccaaaataaagccatctcagctaagagacgaagaccatccctcctcagcagcctgcagggaacacattactgctctccttctagggaaaatgattcaaaccagttcccattcttcagtatagttctccactcctgccctcggtggatattcagatggagtctttaaaggataaatttaaaccagaaaaattatgtgaatgcactttttaaaattatatttccctcaattgctattttgttcttcacgaacttaatagatgaaatcagaacggcaaagtttttaaacaaaaacacacctagtagacttggcacactgtggtgcttgtgttttagcagccaaacccatttgttctcttctttcactaattggatctggctgagaatctcaaatcaccaaataatactttactaaacataatgcagccactctgataaagctgatttcccttctctcttttttttttcttggcaagcatttaggattgctaacagctcactgtgaccttatatccattgacactaagttcagcaaaaatttttccagaagcagtaatttgtaatgtaaaagtttaatatcttaaaagccaatgttgatctccactttggtcttaaagacttttggtgtatagctcatctagaattttcttcatgtcatacagagctaaagcatttatttatgtaacaaataattgtggaattccctctatgtcccaggcactgtgctagatgctcagaataaaatagtgagcaaaatagctagagctacatcccttatggaactcataaaataattataatctagagtataatccagtattcaccatcatatatttttattgtgatcttactgagctcttactatgatgtcttactgaggacatttgatgtaataagagcttctttcatgatgagatacattaattgacgtttgaaaaataaatggagttaagtgagtaaagaaagatgggatattagagttgaggccagaggaggcagcaggtgaaagaaccctgtgggaagaggaagcagggtgaggaaggcatgtaaagaactacaagaaccccaatcagtgaagaatcactatttaatatgagtccgggaatatagtgagggaaaaacaaaacaaaacaaaacaacatatgaagccctagagaacaagttaaagaattttagtgtgacctgatatcaatgggcaattattgaagagtctggaggtatttatatgtataggcatgatcagagggtagagaacatttcagaagttgagagcaacatattgcaaacaaggtcaaaataatgagaattttccccttggaaaagcagaaaataaatcatatggctgagctaaaagtggggagattataaagctgggatggttcaggatggatcaagcaaactgggccagaatcacacgttaagcagtgcgaatttcatactgaggtgctcaaggggaatgacctgaacaaatatgtactctagaaagaaaagcttggtttagcactgtccaattgaatgttccatgatgaaggaactgctctacaatctgtaccgtccaatacactagtcactagctacatgtagctctcgcgcacttgaaatgtggtttgtgtaactaagaaagtaaatttaattttttaaagtatgtttaatatggctaccattttagataggacaggtgtagtcgcattgtggaatatatgtgtgtggggtggtggtggtggtggtggtggcataggtggtcagaaagttggaatgaagaaaaggggtaaagagattattcagcaatctaggggagagatgatggcaggaagaataaagatggaaaaatcatagaggcaagaaataaaaacatttaatttacttgtctagggctcagaggacacaaatagaataataagagagaaagacctaggttaaatttagattacccatagccttgatgccaggtttagaagcctgggctttctccgaagaggagcgtggacctatttaagtttagtgaacataggtttctttactcagaattttcaaaaatgtgcctgtcagaaagtttaattgtggtgtgtaagataaattagcatgtgtctgttatatgagaactcttgtgccattatgcagcagtgactttcttggcctgacaactccttgatggcaaaagctagagcttagctatatattttttccctctcttgacctcacaggacctggttggcaggagatattgaatgtactccagaagagttaatgagagaataaacaaccccgagaatggtgggcaggtgatgaatgcagaaactgcttgagagtagcctttatagaagtttgcaactgattaatttggaaatcttttatccacaaaaatgttctggatcccttaagctcagggattgggattctgccgaaagactgagtattctacctagacttctaggcacataaaaaaccgtgggaaaattttggtgccaattgcatggaaatatttgaaaactttttgtttctgtagtgtttatccaagaaattttaaaataaaatatgttttttatatactttcagattatcttcctaaaagttcacatcattgtgtatccccaccaacagtgtgtacctctgatccctgtccacatcttttcaggaccaaacattaccaaggaatttattttttcctcaatctgacaggctaaaaatgaaatactattatttgactttgaatttcactgatcccttctgaagttgagttttcaaatattttgtatttataagttcttcattcctttttttagcttagttaaaaatttagggttttttttctcaatgacaaatgggaattctttatgtactggtcatattagcctttgaattcttatttattttggaaatatctcaccacactcaaatgtggcgttttgccctttaaaactagttagagcactctttctttttcttttcttttctttctttatttctttttttctttttgaaacaaagtctcactctgtcacccacactggagtgcaggagtctgaggtgaagtagaaagatctccacccacccactgcaacctgcaacctccacgtcccaggctcaagggatcctcccacctcagtccctggagtagctgggactacaggtgcatgccaccacgcctggctaatttttggtatttttttttttttgtagtgatagattttcactacgttgcccaggctggtgttgaactcctggactcaagcaatccatgtaccttgtgctccccaagtgaggggattccaagtgcgagccaccgtgccctcactgcagtcttgataacacagaagtctgacattttacacagtcgaccccataacttttttcctttatgccttttaaattttatgttatacttgacaaagctttttccacactaagattatatagatattctatagttttcattctgtagtatttatattcactcataaatttggatctttgttccatcttaaatttattttgtgtattagagtgaggtacagatctaatttcagaaaacaattttcccaaatgaaaactcaatcaactgtcctgcaagcctttggtcaaaatcagcctcatggaattatgtccccaattcaagtgtttaatgagggatgcaaaagctagatagaatgcattgtcccagaacatctctctgtctatctgggttgtagaaaaagaataatcttatgtccttttaacacatttaatttagaatcagttatgaggccccctatgtcttaatctccgcattacctaatacactgctctatgcatagcagtgattcaaaatatctgtggacttaaaaaaggagctagaaaaaggaatgtaaagaagagtacaacactatttatgccttcaaagttaacctagtagaataagatacactttattcaactatcttttagttgaataagagtgacgagagaggcacaaactgaagatatatttgatacttcattttttcaccatcctgataaagcatttaggatatttacagataatatatgcaaaccattcagcccagtgtctacacatagtaggctttcatgactggtaacttgaaaattattttctattatttcaggggttcaatagagggaaagacttctttaccatggaatcttcaagtttttaagatgagatagtttcatgtggaaaatgagaacctaaacgctccactaaatattaaattttaaaactatcgtatggttatttaccactacaacttaaaaaaaaaaacctgccattgatagtcttttcctaaaagtagacataagaatctcacacacaaaaaagataaacattaatggatgttgtttcaaattatatgtctccgctcttcaatcatagccttcatctataaactctaaattaagaccaaagcaggaattaaactcatacataaaatactgtaactttaatgtcatatgttaggataaatcaataggaggaataaatctgaagtggcagaagtaaccacctttgacttgcttggcatttaaaccttttgggcttgggaaatccactgatgccgcactttaaggggatttgattttataggctctttagcccaagagttttcaggaatacaaaaagcgacgtggccttggagatatgacaggtgtcaggctgtcactgtgaagctgctttgcttttaatggcttgttctcaaatttgaatccataatccactggtagaaaagctgtagacttgctggcaaagatgagagatgctcagaagccattaccttataatagaaattggtagataagtggaccatggaagtttagactctgacctaaagggaagtggataattgcattgaggtaattatcttgttaactttggacaaaattaaagttcacctttaaaagtgccagatcattaataccaaagtgcagatcttcattcacttacatgataaggtaaaaagaagttactaaaattgtctagctttatttaaaacatgataattcgtaattttttatttaaacacatttaaaatgtgcagaaagctcaaggactgggaaaataggagaaaaggtacccctgaatattattatttaaatgaaaaaccttcctttattactttgcttttcctatctggaataagagaggatgcatttgcctttagtattctgatcaaagaaatgagaaagaaaaagatggatgttaatagaggtcatctcaaattaaatctttttactcttcagtcatagcctgtgcctgttatattctaaattaggacaaaagcagggaccaaactaatttatgaaatgctatggctttaaatagcttatgttcaataaattaacacagagaagcatatgctgtgggaattagataaaatctattatcattgataaaaaatttctatcttcaagtctttaggcacagttgctagataattgctacttattgatctctgggaggaaactgatgtcccattggaagcctaattccctgatcagtgctaggtcatgatcactacctcagccaggtctgacttaaacaagtaactgtatgccaatctaacaaaaggcagtgttaagaggcattcaaaaccccacttaggaaatattgcaaggttaggggacagtctactccctcaaagagcagccaataaaggcctttctatttcagcagctttgaggggtatggggtgaagcttgagagtgggaaagaaaaactagactgagtagtaataactcaccccgctaattcaatcttctctgcatgaggcttgtagggcaccttattttcaaatcagatcaaatcagccaagtaagtagggaaacgtaggcacaaagccaactaatcaagctaaaagatatgatttgaatttaattatctatgtattttacagcaaaatataatttagcaaagaaaaaagaagcaacatttgaaaagctatctcatttattcatctcacattgtgagtgcagatacaatatttgaaactgatattctctaagaatattttaaaaagatgtagtaactgagatgtgtttctctaatatattttctgattttaaaaactaaaatgctttaaaattttacttgggatgattcaaaatgaatgacgtgaaattttaagagcaacttatgcatcatgactttaaaaagagacttcaaattgtgtcacaataaattgttctcatgcatcgctacatggttattcctttattcttttagtagtgtttcttaatatattctctggattatttacatacattttgcttcttttttttgtttgtttcttttctttttttagaaggagtctcactgtgttgcccaggctgtagtgcagtggcgccatctcggctcactgcaagctccgcctcccgggttcacgccattctcctgcctaagcctcccgagtagctgggactacaggcgcccgccacaccaccaggctaattttttgtattttttagtagagacggggtttcaccgtgttagccaggatggtctcgatttcctgacctcatgatccgccctcctcggcctcccaaagtgctgggattacaggcgtgagccaccgcacccagccaaattttgctttttaattcaaatgttccataatatatcttcttgatttttagagaattttatgtgtacgatttacaaaggcattaattcatttgcacgattacttgacaaatgttactgaatgcctgttttgagtcatgcagaatgctaactactagtttgcaatggtgagcttaaatgggaactgtttgtagactcatgcagataaagtccagtagggggaaagatactgcaaaaatcaccacacaaatgaatatacacttaaaatgtaaagtaactgccataaaggaaaaccatgtgattcaatgaacatgtgaaaaaatgtctcatcataggaatttagttataaattctgagtaaaatattcatttattagtgtcaagcaccaggatatccttgtatgttttttataaagattttgtcctaagaaatgagaggaaattgttacaaaacctagaatgaattgcagacaagatacgcacaatgtagaaatactgttccctaccctcctcaccaaacatttttataatgtttgtgaagtaggaagaaaggacgtcagaaagcacagaaagaagaaaatatgatcagtatgctaaaaatgtttccttccatctagtagacaaattgctctaaaagagttgggattcagttcaggttgtgtttcatttttgttttttaacccaagcgggcaaaaatagttttcaacataccacttgtagaaaactcttaatttaaatgtgtgtgcataaccattaaatacatgcttagttttaatgttttccagtgattgataaagggttgtatggtgttatctttggtctgttccaggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtgagacacctttgtttatgttgcagtttctcaagataagtaccaaatacaagtaatttttatgtccatttctatgttgatctgctttaaatttagcctgcaattgcatagaaataccatttgtttcatattcaagagaactggcatttttaattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatgcacataggaaggggaacatcacacaccggggcctgttgtggggtggagggattggggaggaaaagcattaggagatatacctaatgttaaatgacgagttaatgggtgcagcacaccagcatggcacatgtatacatatgtaacaaacctgcacgttgtgcacatgtaccctaaaacttaaagcataataaaaaaaaaaaaaagatttttttacttctatagttgggttctccttagttaccttgataggttttcttgagtaacttttcttaagaaattttagttaactattttttaaaaactgttttaatattaacagatgtgtttgtttagttctctggataatatgctgaagctgcttgcaccagctcatgaaagttgattgtgtttatctcttcccaacttggtattcggtgatgccacattgttaatgtgaaatcacccaaggaggaaatattaacaacatggaaacaaaagtcagggccttcttttttctagagttaattgttacacattcaccagcacgccattggctgttggctattccccacgagtaattattgggataacatttgaagtaatcggctctttacagaacagcgatggaaaaaattatttttgagaaaacatatttacctgtgaaatttttgggggaaaagcgactcttaagattatttgcaatttgctcaatctaatatatatggtgatctttgtcttgaattttcacatctgtttcttcacatggggaagaagactcacacagactaaaacaaagcccaacacatgaaactttttaaaaccttaactaaaaataaagctagtggacgtgaacaaaattcaacaccctttcatcagctatgtaaaacctagaaccacatcccttgctaactgtctaaagagtcagtagggtgtaatagctaggaaattgggttttggagtcccacaaatatgggtttgacatcacacatttaggataacattagaatgtcatttaatctctaattcacagtttcctcatatataaaacatgtataatttcctgtacctaacttattgggttctactagggttaaagtattcgatgcaaattgcacataaatagtaaagcctcagaaatgttggctactatagtcattttctgacaaaatggtctgtactaagttattaagctgagggcagaagtgattactgggggaaaagacatcatttgcatatctgtcctcttccaaacctaatttagtttcccatctgtttcaaaagaaagttattttgatttttcctgttatatgtggtactttgtgttacaagtccttctcaaaaattaaaatatcttgtctaatgctacacgctgaaacaaaccccaaatatgttgagcctattactttcggactattacttgtcactatgaacagatacatactgtattacaagcttctatgtctgtcatcagaatgtcagtcttgtacatctctagtacagtgcctggaacatggctggtacctcaaataattgttcaattgatgtatacacttatgtatggctggagcaaatacattgatgtattctaatccaccctcttcccaaaaacattttaaggaagagatttccaatcaatctgtcctcttgaagcctggattcttgctggccaaaatctctctcatgacttcttgggtaactcatttaacccactcagtaaataagtgttcactggcaaaggatcatggtggaagaagggatcaaagtgagtgagttttggaatgagcaagaggcccttaagcaaatagcagataggtgcttctacttgtttgtaatttgtaagtcaggaatgctcaatatggtctctatgtcttttctattcttcacaacacctgcatgtagaagttgctgtaatgatcattattatcacaatttttagagctgagctaaggaagtagaggtgctgcaaggttagatgacatccacaaagtcacagcataaggaggtagtagatctgcacctcagctgatgagacataggtttgctctgggtaggaggccttggtgaagaccaattgtaggtacaggtgagaagcggagctgagccagtttctctattttaactttgctgtctcagttttctagatcagtgctccttaaatttaattgaacatttaagtcactagaggactttttgaagtgcagattccttagttcaaccccaggaaatgcttatctaatgtgtctagaacgtgacttaggagttaggattgaaaaacaaacaaacaaaaaatccacaggtgattcaaacgtgcagtcgccttttagaaccctgctctagacttcattgagtcccattacttttctcaatgtttacaatccagagttaaatgagaggaccttaagcacacgcagaccttaagcttcttgccacggaacagttaggccatcttgtttgatgagcaagataaatttatccacgttgactcagagatactggctgttttctgagcacagagtcctagagtatgggcagccaccatcttggagcatataaaagtgaatgtagtttggtgcccaggtggtagttggtgaggcttatttctggtgtagtgacaatgaatgaaatgaaaataccatttggtacttgtcacctaactgctttgaggtgaggtaacatccctgaagagcttacttcatgccaagactggaggaactggtaaaagctatggatatatttcatccacccaggtaagataagtctaacttatttacttatcaaaatggaagctgtcttattgttggttgaggagacaatataaaccatccctactctgcctctcactattgatgtcattgcagtctctttcctgtggctccaggcagagccctgaaaatatcatgaggcaattcttcaagagtctacttctacatggctttgatgaatgcctatgtagcctaaataacattttcccaatttgctggaacagtatttaacttgcatgtcaaaatttgtttctcccaaattatcacatgccacattttaaaaaaattaactcatctacagtacctaccataaatactgacattttcacttgtcgagggtcaagtatagcctcaggcctgattgtaaaatgaaggccacagtgccaatttagtttttcagtcctctgcaaaaatatcagttgtgattaggtacaatgagaaacttacatgaattaatgcatagacaacctaataaaatgatttttagttaagaaatagaactttcttttctaaaataaaaactatcaatacctaatatttattaggattttacaaggtattggtaccctatgcacatttttaaatttaatctttactggagacttataaggttctccatcattaccaccaccactcccagtttgtagatgaggatctcaaacctccctaaggttctaccatgataatatggaagacgccagacccatatcacctccccagtcaggaatctacaataggtcccatctgtctggcacttcatgccacatatttttcatgtatttatggagctaaaatactgtggttcagagcacagcatttgaagtcgggctgcctaggtttgtatctcatctctaccacttactatcttgaacaagtttttattcctccaatgctcactgtttgtcacctgtaaaaataataataatagtaataataatacttacattatagaagcattatgaggatcttgtgagataatagaaagtgcttggcacagtatctggtcaaagaaaaagatcaataaatcttaactactttatttgcaattaaaaatatctcccaaaagtcataattatggattcctattctcaaacatagattgagcatctttgatctttcatgtatatactatgcattggctcactgtttcacacattcattgaacaaacatttattgagtcccagcatgatgctccactgtgggattatagtagtcatttagacagattctgttttcatagagtgtatagattagaaagggagattggttattacataatcaggaatagtataggaaagggccaatggtatttataaacatagttcccttgatcatctctttcctgtattaaaggctacccttcctctatagctatttaaaccaacatcagtctttccactgtctgaaattgcataacaagtacgtatttaggaaactttcatactaagctacaactaaatgacccaagagaaccacatggttcttggaaatgtagctgaactcttcaaaaatggctcagacaaagacttgaactgattagggagacaacagtaattttatttcctcttacttatcctttattcaagagtgtttttgcttttctcaattttcttctaagcatgttctaccagttacctacttatgagagaataagagctttacatcttttcctgtatgacactggtgcttttctcagtatcttcctcttctcttgccctccaagtctctctacctctttctttctctttctttctttcttccttctttctttctctttctttcttctttctttctctttatttctttctttcattctttcttttttctttttctttctcctttctttctttctttttccttccttccttccttcctttccttccctccttccttcctctgtctctctttctgtctgtctgtctttctttttgacagagtttttactcttgtcacccaggccggagtgcaatgccacgatttcagctcattgcaacccccgcctcccgtgttcaagtgattctcctgcctcagcccctcgagtagctgggattacaggcacccaccaccaagcccagctaactttttgtatttttagtagagacaaggtttcactatgttggtcaggctggtctcaaattcctgacctcctgatccacccacctcggcctcccagagtactgggatttcaggtgtgagccaccatgcctggcccgacctgtttcgaagtttccctagcacttccttttgacagaggagaatctggctgtcccctagaagtctcttggttagcagtaatagtcagaattgcacatctttaaatgatgcaaactttatttttcttttctgtcccccgtaagaaatataaataacaaaacctggtaaaagttgggattattgcttttagagtacagaaagatgcctccactcaggattagaaatgccaaactagaatcgtagaatggtaagataggtggaccttcaaagagttagtcccacagatgagaaaactgaggcctagagtgttaagataacttaagttcctatagcaagagctagaacctatttgaatactgaatccattttgcctttagtataaattacacaacttttacataagagagctcctcatccttctctggttgataaatataggttgtcttgacattgttccctgtcactaaacaaccactggagaggacaggtttggataggtgcttttgtataattagtaaagtatgagctttgaaatcactcatgtaatttctgtgttcaattctgtctgctacttaccaactattggatgtggtactggtcctttagccttgttcttctgatctataaattcagaatgaaaatacctgctgtgaagattcaaagaaacaatgtatatgaagcgcttatcactgcccttggcagaaggaagttttcagtaaatattacctattatgttacttctgagatacttattttaatcctataataatctaaaaagaatccatcaatcagagcatgtcacttacacataacccacctcctctatttagcatctttgaataatttctccctgcaattggaataaaatgtaaactgtctgcatgtgccacattttataacttcctttttatcaaaataattttaatccccttgtcccttcccaggtgccaggtcttctaaaaatttaaataacagacaaggtttctctttctcagaaccctcccttaatttaataatgatcaaaaggttagtttcttcttacattttaagctttactttaaacatcaacccctcaaaaaggtcttctctgagcattccatctaactagcttctcaccatccctgtattctccatggcacataccataatgtaacattatacttttctctgctgacatgattcacagtatatctctctcactaaaatataaggtacacaaaggccagaccaaatctattcatcagtgtttgtcatttcaactgatacatagtagacaggcaataaatatttgtaaatagagtgaattaaatccacttatacctcctttcccattgctgaaactgcccatcagaagtcatgaaacaatgtagtctcacgagtgactcagttacccaacttgcttatgcaatcacatgacctgtattattacacctctcttcaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgtatgtatcattttccattggcaccattgaaatttttatgatttcggtttagtttgttttcattagcctatctgcaggctaaggctcagcagtttgggctccaagatgaaaacagcatgtatgagtttagccaggccataacgattcatttacagtcattagttacttgagagagactcaagtctgtttctattttctgtgtcagagttcttatgcaaatataattacctgctctctttattttgtggagactaaagccatttttgagaaatgtgaccttcttcttgttgctattattccaggtttcactgattttttgagatggagtgtcactctgttgctcaggctggagtgcagtggcgggatctcggcttactgcaacctctgcctcctaggttcaagcaattctcctgcctcagccccctgagtagctgggactataggcacacgccaccatgcctggttaatttttgtatttttagtacagacggggtttcaccatattggtcaggctggtctcgaactcctgacctcaggtgatccacctgtctcggcctcccaaagtgctgggattagatgcgtgagccactgcgcctggccatgataatattattaaatcactgatattttaaattaaaacttccatctcaggcattccactaggaagctataaggtccttgaagtttcaaggctgactacatttttgcaaatgatttagtgtgtgtatggaggtggaatgtgggtattgtcaccagataatttctattgatttcattctcgaaatgtatctttttgtttttaaaacaaatgatttactattatatgggcaagttagttagcctccttgtgtgttttatatatatatatgtagtgtattatttaaaaacacttgtcttatggggctcctatgagaaataaatgtggcaatgaagggcaaaacaaaaaatcccaaaatattacatagtactctacacatgaatgtacttaacattagtagttggtgatgatagttgattttgatgatttatacagtttccagcctggattgacttcagtgccacaatttgaaaacagggaggatgacttctacttgcaaccaaactttaaatagtgaggatgaagcataaacacaaatgcctaaagcaactgttttttattgtgagtgttgaggagagcacatagttacccatttacacacctgaacaaagtggctggctcatagaaatccccatgaaagttaaggtccattcccttccaagatatgggcaaagagaatcacctgacaatcctggatcatggccttctgctttgagagccgtaataacgctctacctatccaacccagagactttggaggttgaattgtaaggaaggaatttagctgattctaggttgtattctgatgcagctgcagaaacccaagtgaaatactacaagagtaatgtgtttatttgaatgtaagactttggaacatggaaagaaagaaacatcattattcttgatttaaaaaatgctttctttaattgctcaaatatttacaatgctttatgcagtccttcccttccctgtctgttttgcctctctctgactttccattttctctatccttgttttattttccttgttgtgttgtttttgtttgctccctcttgttcactttccatttcactctccctcaagaaggtggttctattgagagttggcatattacctgccagctataacaaggacatgaggactggctttcaaacaagttctgatgagtcctttggaaaaagccccttggccctctctgtcagctacgccattgcagagtagattttgttgcaaagatagaggcagattcccttattcagggtcatggaaatggcagaagaagaaaaggcagaggagaacaggataaaaatttgagaaaatgaaattacctgagaatttcatgcacttctttttaggcaattagatgattcatcagaactagcaagaaaataaactaggaatgagaagctgaaagtttattttcctgtttaatatgccttttggataattgtgtcaagactcacctattaagttatccgtgatgataattagaaaatagaatcatagtatttttaaacaggggaaccaggcaatagaaaacttccttgcaattgaacaactctggcttcttcagtcaagtaattgtagattaatttattaaaaatttcactagtaattacaaaattacacttaactttaagcaaatactttatcccaagctcagaactctccttctgtgtttataatttcagttcatttcacttactgtgttttcaaaatgtatttttaatttatcttgtctctctctttttttttcattttttttctcctttttattaaaaacaaatgcaattctcttttctgtctacaaacccaaagcttcttcggatgttttccttcaaggtataatgtttttggaatggaaattcactgcatgcaactgctaaatttaactattaatgcttacatggtgttttattttgttttatgagtagacatttaagcattctactagagataatatgttggagaaagttctacagacttctagagttgattcagcaactatacactaattcacataggttttaatcttacaccaagcccaaaagctataatccctgtgagatgtcataggtaaagaaggctgctttatccatcaaagccaaaatgagcttcctcttttcagatgaaaatgggattgagtcttactgattacgactaccaagtttgtactcttttaaaactaaaatttaactctgtaaatcttaattcaaaatgtattggttcattactgtttgtaaacttaatgatttctgtttttctgaacactacctgtaagttctgtaagaacaatattctttttgaaaggctttgagttaaaatatccattccttatttccagagtgatccctgagccttttggctctactataatgtgttgcaatgagatttctattcaaatataatagctgattctgagacgttagaatttctgtttagattatgctaaaatgaaatcatccaaattaacattaaatatatcatttagttgcatagaaatttaccaactggtctagcaggaaatttgacaagtagtaaccttcttttctcaatttccattcacatgtaggtaaacattgttgacattcttaagcttatagatggtgaatattagaaaaagaatcatagtcctttaaaacataagccataccattgtggtatacaatcaggaaaattctgtatttatatatattttaacattttctattaacatttaatacatttgctcagagtaatgggttttctatttgcctataactaagcatgacacaatatttgatttcagaattgatgcatttttatttctctgttccactcacatgcagcaccatcaaatgccttcatgtaaccaatgtcacatctaatacttactagaataagattccatgtaatttgatttaaatatttaactttgagttcttttggtgttcaatctccttgctatagctattagcttgatgatattattttcagctgcactgcttaagctcaaaatttgaaatctgcaaatgtgctatctttctaagttcaattttaccattgtagatcatgatgtcatagcaatttcctgagtacccattttcagattcatcatcacattggtgacattgtggaaaaacagcctaggatctctcgagaacaactaactgatccctctccttccctaccctcgtcccaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcatctca

SEQ ID NO: 44 - DNA, 77778 bp, Homo sapiens
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaaggtaagtcaacgttacgttctttctgacaaaggcagatacccaacgcttggcttttcctcttggacagagacagggagagggcgcgcgggcagagttaatttctaagatgaaggctctgtttgcaggaaaagcaggtctgaggatggctttttgaaactgctctggaggacgggggctttcttctcctccctggcctgccgtgtgctgtttttctcctgtctctctgttgttcatgctcctctgagattccaggggacatgttgtgcgtctgacagaggagacattaggggaaggggagcgcatatcaaaaccagaaactttatgcgcatttctggaagaggaacaacggatatgtctgtggccgtgggacccagcagccccgtacctggggagagcactggccgcttaagcagaagacctctctgaagcagggtctcagagtctggggtgtgtcatgtgtgacccccacccaaggtactgaggagaggtgctcacgtgaacgttttgtctgcatgtcatgcatttctcaacttaaggatcaatatctagggtgcatgcgtctgtgggatagatgtgcagaagtaaatatcggccgctcctctcagccccttttttcgctacgtgtccgtgcagctgtggagtgtggttgtttatggtggtagtgtaactggatttttgtatttaaaactaaaaatcagggttagctaagaagttgaacaccctaatgccattgtctgtagttctggggccgtggactttggttctgtctattgaattcactttcttctctataaaccaggaaaataaacaagtgctggtggctttgtgttggagtggtgggttctcactgctcctcctgagtcaccaagggctttgcttgtctcagcatcacctttgaatcagtggacaccattggctggtaaagttgggtgtttaattttggaaaccaaacatttgcggtggtgcggggggttccgtggctgcaggtgggtttggtcctgggcatggactctgtcacgatgatgataatggcagcgatgattataattatccttttgggagaggtcggtggagaattttgcccttgcagtttttttttttcttttaaatcacagaaaactgaggacacctctaacgccagtggctgagtgcacaaaaggtgggagggatgtggggcagacctgggggggcccactcggtgctgaggggtatgctctgcctctgtctcctctgaggtgccagcagagcctgtcctggcctcactctggcctggggagtgggggtgctgtatcctctacagggctgactgagggaggctcccctcggcccccagcctccctgccaccccgggctcccctcccattggtccttggctgtgattatcgcctccttccatatggccctgttaattaacggtaaacaaaagagtaagagagcagggattggagtcctgtggtaccagccagggtgctgctatcagtagaggcaggaccctgccctgtctccctcggtagctgttccttgtgcagaggaggctgggtcagggcttagagggcagtttgttttcaaagagaaggaggcagtcttatggattcttctgtcccgtagagactgagactcctacagggtccccccgaccccctgggcacctggacgtttgccgaacttcccaggggtacttgctgatccaggagcttgagcaggagccacagagagttggacaaagaggcctttctgctctggaacagcctcggctctgacctccttgggccatgaatccctgaagagggcctggtagccctcttcagagacccgaggcaggggggctgcttctgtccaaagtgccactcgagggtttttgtgaccctcagccattgcccacagatctggaggtagcctcagttgttcagagctaatgctctggcccctcttggaagattctggcaaaggcagtggtcacctactcccttgaatgcccctggtgcatgagtggggaaacactctctgagatgaccccttctagccatgtgggatgcaaagttgctctggtctgggggttgcagcagcctctacttggaagctctgttagtgccggagatgtcagggagaggctggcagagggtatgcggccacgggggtgcatgctgggcagctctggcagctgaccaacggcagcctggatggtggctggagcttggcctgtccctgctgtggatgtggtgggcgctctccctggtgctgctcagagactcactcccttcctctctggcctggggtcactgaatgtgcagacaatgacatttgtggtggtgtggtgggtagaggagacccacaccactctgcactggggagacaggggtcagagcctgactaactgtcttcctggtgctgctcagtctggtgatgtctgggccgcttggaatgccagtttgcacaacccagtactgtgcagagagagcaggagaggttcctgaagactgacaaagtgccagagagaaacccggggcctccagccgctgctcggtggcagtgggcgggctggtgggggctgagctcttcctggacggactcagtgcaaaaggtgcgtctactttggaaaagactgagcaaggcttgtgtccacccagtccctctgtcggggctcagggtggggatgagaccgggaacaaccagaacactttggtcagcaccgggcctggagtagatgaggaggtagagaactgacccagctggtggaacaggggtcaggaggttagctgtggggtgggtgggggctgctggcggtcacctgatctgcgagcaggcagggtactggacggtcagccagactttcatgttactcaggcatcttgaagagtggatgctctgcctgtcccaatgctggaagacacatctcagagcccctcttttgttgcctgttctcttgtaggaacctgggcgggagagtggagcagggtgcccgcaggggctgggggggctcttctctttcttcctctctcccatcttcctcatcttagatcctccccctctgcattttccgtgtgaactccctcatgaataaaccagaagttagttgtctacagatgtaattttaacaggaatgttgtggtgtgagtttacaggaaaatggtctttgggaaccagcatcattagattagtcagaccgagaaacgccgtgtttcccagaagggaagagagcagtggctgccgtgctgctcccccgtgggcttcctgctctttggggactgcgggacccatccccgctccaggacagccccactggggagcccactgcccagcccggagtgtctgctggaggcctggggggtggaatgtgctttcacggcctcttgaggttcccggcatttttctgtctttcagaccaaatttccccaaacatcactttaaaaaactcaaaacaaaaatgagcaagaggaatttcaccggaattaaaatgtttttgatctcaggcttccacggagccagcttcagagagaagagattaatggatacttgcaagtggaaagtgtagtttgaaaatgtcttcctgtttctcttcagtgttactggaactaaccagatacaagtgtggagtcttttctccccagggttaatgccattaggagcgttccttgtgggaagattggtttcacccatcacttcatccttttttttattttacaatttgcacttaaaaatgcaatgttattttaatcgggaacgaaagtaactcagcgtgctttaatctgccctggctgagtacatctgccttggccaggattggagtccaggccttgcagaggagagaggatgtcgacacagctgtgggtgtctgtggtcctcctgccaccccttgtcctgcagcaccggaagcctccactcagcagccccaaccttcaagagagtgactttgtgctctggcaactgagtgtgtggtttgccctggggttgcttggagttgattggatatgttccctgtgccttggggtttatttgggactgtggcctgggagcacggcctgtgccaggagggtgcaggttggatggtcctcaggaagtaggctgcagcgctctgcaggagtcagggtggccaggcaaggtgggggtgagcactggggatctggatgctcgggaggaaaggtggaggcaccatatggcctgagctgctgacagatgagcctgctggccccacctctctctcacgcctggcttcacacctccatcgtgttcaacactggtctgagggctggggcagaagccatctgggtcctcttctttttttccattttgctgcctgcaatccacacatcagaggaggagcgtgagaagagggggccctgggtcaaggcggttggagcctctcacctggtcctgggggaccctccatgtctccctcagggacccacagagctgccagtggctgacctgtcctgcctgagtgggaggagagtgggagtttggatgctccatggtgcaccaaggcctgctttagaaggccctagaaggtccctgagactctcggaccgcaaactgacagcagcaggtgcctggggtggcctcccagtgagccagagccacagacccgaggcgcgtccccaatcccggtgtgcgcctcgctgagctagcttgtcaaagcgcttgggtctttacacctacagggtttttgggttctgaaaatcaaatggctttagcagtcctgctctgtgggcagccaaagtggctcctaactgaaggtgctgcccattctttacaagacttagagctgggggacaagttccctcttggctctgagtttcccaggataactgccgtcccagggagcccggggatggttcagagcagcctcccagttactgctgactgaatacttggttgtcagtcgctcgtcagcatgtgggattgtgctcaccctgcccttaccaaagttttgtttagggaaaaacagagatttgaaattgggacgacttactatggttaacattattttcattgagactgggccttaatcttcgaatggaacaaaaaatctgacttaggtcgtaaggggcagagaaacacgtttgacgctgttattttaatcgttgagaccgtgctaacttgttcagttctcatgaacgtgttctgtactggacactgaggctgggaggcaaattagcttcccaggtgagtggtgtagctcgaatctaagatctttccagcacagcctccctcacagtcccacccagccccacccagccttcctgccgagtgccccaggctgccatggaggctgcccgcaggccacagtatgaccctcactgccctcgtgtctcttcctcacagcctgggacatatctagagcctgtccccagcataccctccaaccttattctccgtcccaaactgggttgttacccacgattcccaaacatgcctccctatctcccttcatctcctgcagctgaatttttgcttctctttcaaggcttcttacagatgccaccccgggccctcctttacttacctttactctcacgtgtctcacatttgaaatcccgctctcgggatgcaatgtctctgctgtgacattgcatcagactgatgggtatccctgcttgctttccgggagagcctgcaggcaaccagctctgggggctgctgggcctgaggaaagcatcccaagtcaaggggctgctggacccaatggggcactgcaagtctggaccagggaaggatccacattttagctttgaggttggaaggacacttgtgttgggaagaaaagctacttaaatgctcagttgagcagttctgaattattcctccactctgttccttcttgaggttgagccctgccttctggttatttgagatcaagtccgcctagataaaatgttagactattactgcacattaaagaggtacctcttacagtcatttttttttaagtggtctgattttgttttggctggcttatttagagttttgtgcttcctcattttatttccacgaaggctgtgcccaaccttagcctcggtgagccgtgacccagccatgtcaccgatgcgtcaaagtgggttggctgtgaggcattcattctctccccatgacacagatagacaaattggtcatatatatatatatatatatatatatatatatatatagagagagagagagagagagagagagagagagagagagagagagagagagacggagtcttgctctgttggcctggctggagtgcagtggcgccttcttggctgcaacctccgcctccgggttcaagcaattccgtctgcctcagtctcccaagtagctgggactgcagatgcgtgccaccaagtctggctaatttttgtattttttttttttttaacagagatggggttttgccatgttggcgaggctggtcttgaactcctgacctcaggtgatctgcctgcctccgcctcccaaagtgctggtattacaggtgtgagccactgtgcccggccaaatttacccaatttttaagagttatgacgtgctgcaagcttgctgccttccctcatccagcggtaagtcctgtaaggagtctgcttcctaggtgcatcagccagatagggaaaacaaagggatttgttactgaatggcattcagggaagcaatccctagaaggctgcctggagcctgtctcggggaatccgttccaggactctgggccctgcacctcttccctgtggagtgtcacccacaccggtggcctgggctttgtctggctgcaaatcgcacatgcggcttctaagtcagaacctgctgctggatgtggagctcccttcatccccagggtctgagcctttgtccttggctgacccctatcctctggcatctggaggaacccaaaccctaacccctaacctctggcatctggaggaacccaaaccctaactccctacacctctggcatctggaggaacccaaaccctaacccctaacctctggcatctggaggaacccaaaccctaactccctacacctctggcatctggaggaacccaaaccctaacccctaacctctggcatctggaggaagccaaaccctaacccctaacctctggcatctggaggaacccaaaccctaaccccctacacctctggcatctggaggaacccaaaccctaaccccctacacctctggcatctggaggaacccaaacccacttcaatataagagttagagtccaattcctcttcctggagagccctctgatggccttgggaccctggacctggtgagctctccccctgccagcccctcctactggccacccacttcctgcccagtcacccagaggccaggccacctctggtgtgggtaaagcgtttgtgttttccccaaatgtgttctgtgttggctctcgtgtactgaccactgtccatccaggctgggaaattaccatacacatccccccgccccccacaatttttctaagcctgtagagcagcagagggggctgctctgagccctggagctagggctgcagttggacccatcagagagcagctgcctgggcttaccctacccaagcagggatttgggcaggggtcctgcagttggagagcctgggattggagaaggaaaacagaactgttgtgaaagccaaaatccccaagggctttgaggcctggggatcttccctcgagctctctcccttctgaactggggatgagccagcgtgtgggctcatcctgaccctaaagggaatgtgagatgcccctcctagtggaattttgtcttcaaggcctcagtaaaatgtggttttaaggcagaaggagatggccatttcctttctttttgggctggaaagctgaacggttctaagaaaaatttctgggaccaaggaacgaaaatgctggagcagaattccagagcaggacctcttgatcccgcgaagccgacgtgtcttctggggagttcccaaagatccatggggaagacgcccccaaacccagtgctgctggctctggccataccctctttttttttttttttttttttttgaagatggagtctcactctgttgcccaggctggagtgcagtggcgtgatcttggctcactgcaacctccgcctactgggttcagcaattctcctgcctcggcctcctgcatgtgccaccacacctggctaatttttgtatctttagtagagacagggtttcaccatgttggtcaggctggtctttaactcctgccctcaagtgatccacccacctcggcctcccaaagtgttaggattacaggcttgagccaccattcctggcctcataccctcttaattcttatcttgcatctggaatacctgttggaccaggcctgtttccatcacagccccttcttattgcctttgtgttctctgtgttctaccccttcccataccccaggattcaggcaggcgagtccagttgtgcctgattggaaaaagtgtctctgatggtggcccagtgaggcaaggcccatgggtcagcctggccaatttccctcccctcctgagcaccgtgggagggtcaggcctcaagcagccctcggaggcagcagtcacagacagaggtgggctgttggacaggtgcggctgatagagtgggtgtcttttgtgggcttctccccagcctgtggcctggcctagtcagtagagatggtcaggggagcaggagggagcccataccccagtgcctgtagttgtgtccatttcccctccctgacttctcctcctgcagcatccttccctttagttgtgtccatttcccctccctgacttctcctcctgcagcatccttccctttagttgtgtccatttcccctccctgacttctcctcctgcagcatctttcctagttgtgtccatttcccctccctgacttctcctcctgcagcatctttccttgtagttgtgtccatttcccctccctggcttctcctcctgcagcatctttccttgtagttgtgtccatttcccctccctgacttctcctcctgcagcatccttccctgtagttgtgtccatttcccctccctggcttctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccattccccctccctggcttctcctgtagcatctttcctagttgtgtccatttcccctccctggcttctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccattccccctccctgacttctcctcctgcagcatctttccctgtagttgtgtccatttcccctccctggcgtctcctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccattccccctccctggcttctcctgcagcatctttccctgtagttgtgtccatttcccctccctggcttctcctgcagcatctttccctgtagttgtgtccatttcccctccctggcttctcctgtagcatctttcctagttgtgtccatttcccctccctggcttctcctgcagcatctttccctgtagttgtgtccatttcccctccctggcttctcctgtagcatctttccctgtagttgtgtccattccccctccctgacttctcctcctgcagcatctttccctgtagttgtgtccatttcccctccctggcgtctcctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttcctagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccatttcccctccctggcttctcctcctgcagcatctttccctgtagttgtgtccattccccctccctggcttctcctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctcttctagcatctttcctgctccctggtagcctcttgggagccacctatttctggaggtccccactctgggttccttgtcctgggtgtggggcgaatgtgctggactggggtcacagcattgaaccccacttggagctgaggatgttctcgccccagaaggaaaagctgtgtgtgtctgcgtggagcagtgtggagtggtttccttggtgccgcctgggttccgggcacccggcctgggtgtgaggcctggtcacatggctgaactgctctcccaggcaccccgggagggatgaatgtgacactattggtgtccctcccagcacactgcctgccctgggctgggcacactcctcccctgttggcagccggggatgacaggccgcctggagagcccgtcctgtgatttggtttggaaagtcattattactgcagagcagtttagctgttgtttttacagcgttggtaaggttaaaagaaataatgataataatataagaaagactcagccacagtaactgcctgcaacatgctatttgcatttttaaggaaacacttctttgagacagcctgggtgaaaggtcactatttgcatataaatggaaaagaaagtgtatgatgctggaagttacatctgtattattttctcagcagtgagctgctgttggagagattagaggacatggcttgcatttggcttttattgaatagagaaagtaccagcgaggctgatttagaagcaaaataatgagagaaatgtgcaaagctatagaattgccaactccctgcccccacctctcccttctctcattttcacctaaactcagcaaaagctggtctgcctttgcgccactcagcaagtcttcattttacttctctctggattccagagaggaaaaaaaaaaaggaaagaaaaagagcaaaacttgccctcattttcccctcggtcccatttgtgtttcctgccagtgtttcctccagatgccccaaaccccggagcagaagcccctgtgactgtggccccccagggtgtggagaggaagaggccctcggggcggggacaagagggcacccctctccagggtggggacaagagggcacccctctccaggggtggggacatgagggcacccctctccgggggcggggacaagagggcacccctctccagggcagggacaagagggtacccctctccggagctagtgggcctgttttggacccgctgctgggaaaggctgggggcaggggcaaatgtggggggtcctgtgtgggctgagggagtcctgttccaccttcccctcagccccatgggacccgcagtttctagggcatgggttccaccttcttcatggaaatttccaagcttgtcagactttctcaggtgcctggtcccctgggctttccaggatgcccccaggaacaaagccagccatccctgagagaaaccctgggtggggctggggccggcacctgcccagccagctttggaagcagacttggctgagcacatcatggacttcagggtcttccaggagcagtcctgggacagagggaggtggagcgtcctgcccggaggaggcacctcaggatcctccttggtcccagcttctctcttcacagaggcctccactgaccactggttacttaaatcacagtcccccatcctcattattttcaaaaatacattttgaaacaatctcaaagccacagaaacgtttcaagtaaagggccaagctgtttctcctgagcgtttgagagcgtgttgctgatgcgatgccatcaccaaggacacttgcatgggtgtttccagcagagaggccgctctcccactgctccaccctcaccttctcggccatctggtcctcagacccattcaggggtgggttcagaaccacgtgctgtgcgtggtcctggtgtctcgttcgtctgaagtcgtttttagcactcctcgcctttcgtgaccttgtgcttttggaagagcgctgagccgttattcagtgggatacccttcaacgtgggagcactgagccgttattcggtgggatacccttcaacgtgggagcactgagccgttattcggtgggatacccttcaacgtggcagcactgagccgttattcggtgagatacccttcaacgtgggagcactgagccgttattcggtgggatgcccttcaacgtgggagcactgagccgttattcggtgggatacccttcaacgtgggagcactgagccgttattcggtgagatacccttcaacgtgggagcactgagccgttattcggtgggatgcccttcaacgtgggagcactgagccgttatttggtgggatgcccttcaacgtgggagcactgagccgttattcggtgggatacccttcaacgtgggagcactaagccgttattcagtgggatgcccttcaacgtgggagcactgagccgttattcagtgggatacccttcaacgtgggagcactgagccgttattcggtgagatacccttcaacgtgggagcactgagccgttattcggtgagatacccttcaaggtgggagcactgagccgttattcagtgggatacccttcaacgtgggagcactgagccgttatttggtgagatacccttcaaggtgggagcactgagctgttattcagtgggatacccttcaacgtgggagcactgagccgttattcggtgagatacccttcaacgtgggagcactgagccattattcggtgggatgcccttcaacgtgggagcactgagccgttattcggtgggatgcccttcaacgtgggtttgtccagtgttgcccgtgatgcaggaacacctgagtgggaggttctcccttcacctgatgctgatttgtcccttaactcataatgttgacttggtcactggattagatggggcatcccagcacctctatgccagagggaaatgccagtcattttccctttgcaattaataaatatttggggggaaggtactttgaaactatggaaatatctccatcctcaacaaaccatcacttaactttgatggatatctctatagactcgttgtttcctgttttaccccatgggctgaaagccttctttggatgctcagattgtccctgattgaccagtggaagcccagtacagaggctcctgcagcctcggtccagctcccctgtcctttcttgttcttgcctttcctgcttggggcctggaactctggttccttttattagaaaatggtgttagcctgagacctgggtgttgggcctctagtggacatggctgggaagacgtatgtgtgtacacacacatactcacatgctacacacagttacacaatgctacacacacacagttacacacacatactacacacaggctacacacagttacacacacgctacacagttacatgcatgctctatacagttatacacacatgctacacacacagttacacatttgcacacagttacacactcacatgctacacacagttacacacatacgccacacacgctacacacatgctacatgcagttacatgccacacagtcacacacagttacacaccacacgcagttacacacacatgctacacacaggtacatgctacacacacgctacacacagttatacatgctacacacacgctacacacagttacatgctacacagttacatgcatgctctatacagttatacacacatgctacacacacacagttacagacacacgccacacacacaccctttttcacctaggtctgtatttacttctccatctatcgatgtttattgaaaaacacaagttcatattgataacctctgattccaattcccacacagggttcattctaaggttctgcctttccgtaggcataacgtcctcttccaacagtgagaaagctggtttccattatctttaatgtgtttacttctttgatccacctctttccccataccagcaccctccttactccacacaagtgctgaccccttgctgagcccctctctgcaggccaacctctgggtcgccacaggacagccccaccctctgttctaggccttggtggggacaccttctcccctgcaagggctctggtgctggggagcctcactggccagttgcccaggactttggggttcacagggtgtgggccaggacaatccaagtataatgggctgattggcctccctgtggctccagaactggaccttttcggacacttgtgctcacagtgaccagctagcttcctttgtagcgttgagcgttatctttctttatcttcagtgtttcgctggtggaccaaacagtttaccagtgttatgtctcatacaagattttgtggtttgtttttcttgtagacagtgatcaccacccctgccacatgcacctccctgccctcgcttcccttactcgcggttcaatgctcagtttttgaggctgtgcatatctggatttttttattcttctacttcctgtgatcagtgttttgcctgggcatagaggacatgccctgaagttgaatgtcaactcccttgaaattgggaagaggctttctctactgtctgtgaatgctgctctggagcaatgtgatcctattctagttatcggttttgtttgtgactttttcccacttcaaaagcttttagggtcttttttctattcctggtgttttaaaattttatagtgccgggcttggttggatgtgggtctctttttattcacgattatgggcacttaatgggctttttaatctaaaaatataatttcctttagttctcggaaaattttttttattatttaacttacacttttccttcccattttcttaattctctctttctggaactcccaaatcgggtgtcagtcctcactcagcgtttcctccgtctctgctatctcttcgtccttttgttcactttcctagtatatttctttgactctatctcccaagtcttctgttgaatttttcattttggttttacaatttatttccaagttggggaggatggacacaatggtattaagccttcccaaacaagtcctcctgtcactgtctgggctgggccatatctgccctgtccacatgcgtctggagagtctgtgtcctgcctcctggtttgtccttgttcctgctctaaccgctgcccacactgttagtcgagggagcctgaaggagcctcctgaaacactcatttgctcatccagtgcaggttcctcccacaggccaggaaaggtcccaggaacagccattattgagcaccctggcagttctcagactgcggtggggacctcgctttgaactttgagaggcagatgctggacctagtatttctgctgcctcctccaggagccatgtgacatggatgtgagtctgtttgcctcctagggccttaccttcctatgtctgggggtgtagcctggacctcaggggtgtccccttgggtgtcagaggctctttgggactagagggaggaatcctgggctgtggtcccccaggagtctactgtgacctgtgactggtttcgtgtgggccttaaattgtttctaaatttttattctaaccgttttcttgctgccttgccaggctctgatttaaacccaagtagcagcaagaaggggataaatgagggattgagaggagaagcaggaaaaaagttttttgttttttgttttttttcctttcgaatggcaagatgtaagtttatactcaaccctgggcccagcttttcagtttcactctgcatgaggtatgatgaaagctaagaaggcctgccctctccagggaagtggcggctggagcagccacggtgtcccagggcgtggcaggcccagccaatacgcacgcacaggcagaatggggggctgttgctgctgggttagctaccaggtgggattggccctggccatcggctcagctgcatggatagctgtggacacatcctgacatagcactggccgaggtgggaggtgagcttgggccgttctgggtcccgatgcctcctggctgtgcagaggcaggtcgccttcctttggccctgttgaatgagtacagctctaactgctctggggagtgggagggtgaagtggacccaagagctctcactctgacctccgtggcctgtctcgtgtcactcgcatgacccatcctcctgttgtatccctggacccagccctccctggcctccaggagcagggagtgataggcatcaaggtggtccagtttggggttgaggcgcagcggtccagaggctggcccaggacacaggctcacagaacccagtctggagaaccaaaggggacttgctgggacctcctgccctaggcaagagtccccagagtgtctcactgaccatccacatgccactgtttaaaaacagcgttattggaatgtaatgtgcacatcacagaattcacctattaaaaatatacaattcagtggttttagcgtacgtgtagggttgtacatctatcaccacagcccaagtttagaccgttttgatcaccccagaaagaaaccccatgcccgttcacagtcgttctccattttctcctccaccagtcctaggcaaccacgaatctactttctatctctacgaatttgcctgttctggccatttcacaaatatggaattgttcaatatgtggtcttttgtccctggcctctttcactgaacacgaagtttttgagattcacccacattgttgcatgtataagcaacttcattcctttttattgccaaagactgtgccactgtatttcgtatcacccattcagcagttgatggacatttgggtttttccactttttggctagtatgaataaagctgctatgaatagttgtgtacaagcctttatgtgacatatgtttttatttctcttgggcaaatatctagagtggaattcctgagtcatgtaactctatgttgaacattttgagtaactgccatgccattttccaagtgattgtgctattttacattcgcatcagcattctatgagggttcttgccaacacttgttactatctgtttatctttaacattacagccattttagtgcaatggtatctgagtgtggttttgatttgcatttcctggattactagctgttgggcatctcttcatgtgcttattggccattcccgtgttatctttggagaaatgtctgttcaagtcctctgctcattctaaaattgggttatttgtcttattatgagttatgagagttcttttttccaaatacaagctctttatcagatttacgatttgcaaatattttctcccagtctttgggttgtcttttcaccatattgatagtgttattcatttatttatttttgagacagagtcttgctctgtcacgcaggctagagtgcagtcgcatgatcttggctcactgcaacctccacctcccaggttcaagtgattctcctgcctcagcctcctaagtagctgggattacagacacgcaccgccatacccagctaattttgtattttcagtagagacggggcttcaccatgctggccaggctggtctcgaacccctgacctcaagtgatctgcttgcctcagtctcccaaagtgttgggattacagccgtgagccactgctcccggccgacagtgttattttaactccgaaagttttaaaccttgttgaagtccaatatattactttttttctttaatggcttgtagtgttgttgtcatagctaagaaaccattgctgaacccagagtcggaaagatttaccgcggtgttttctaggagttttggttcttacatttacatatgtgatccagtgcgagctaatttttgagagaggtccaacttcatttttttttttgatatctagttgtcctggcacgtttgttgaaaagacagtttttttcccattaaattgtttttgtgccattgtcaaaaatcaattgatcattaatagagggggttacttctggactctcaattatgtcccacttatccatatgcccgtcctgatgctagtaacacattgccttgattactgcagctttgtagtaagtttggaaactgagaagtgtgtcgtccaactttgctctttttcagaattgttttgactagtctatattccttgaattgccatacaaatttttagaatgagtttgtcagtttttgcaaacagaacaaaacaacacagccagagaggtcagaaatggtcagattctggtgagatttagaaaataacattggcaggatttggggccaaggatgaccctcagggttctggcttgaggagctgatgactgaagaggggaagaggaaaaccccacgtcacgtaagaagcagatattgtgggcagcgaggaagcaaaaaggagaagccatctgacatggggtggccgggtggccaggaggagcctgtacaggtgaccgacaaggtcaggggcgagtgtttgccacagaagggggtgaacagacacgcaccgcagtgatgtctagtgggccctcacgtgccctgtgaacatgaagccgcctgttgttccagtagagggatgtgggtggaggccaactgtggtggggagtgaagcgtagttatgaagcaggaggagatggagagggggctgggcaggggcgtgaggtccaaagagactgtgtttttaaacatggatgcctcaagccagttgaagagttgggaagagtagttcaatattccagaagaatggagggaagagttgatattcctgggaactttcattgacagtgggaaggaggtgggtataaagtccagatggacaagctggctcagcagggaggcaagaccccatctcctgtgctggagacggaggagggctgagggggtgcatgggagaatggaggtgtgggctcctctcaagtgactacccttcccctctttgctgaggggcaggtggtaacagctcctggccccaaaggcagccctagttaccagagatgcaaaacctagtgaagactgaaaacatgtggctttccacacttaccacctggcctctcactcagtcttcctgttattttgttcttgttttcagagtggggaggttttacacagtggaagggggtcaggttgccagggctggagtggatcagagctaactgccacagggactcccatccggaggcccaggggatgcaccatgggggcaggtgggctcaggccagattccaggctaccgagccagcatgaaaacagccacggtcgcccgcagggggtcccccatggggttgtgcgtggagtggccacagtgccagtgcaaggaggaagtgtgtgctggcagtgggtcagccggcagctggggtgttagctctgggacaagggggctctccttgccatgacgacagaaggaaaccttggggtaggccagcagcacttcctgggaagagcccagcagagcactggctctcagtggaagcgtcctgtctggggcctgggtcaggctggtctccagtttgcagtgctgctgagttggaaaaagagggcttcattaggagaagacagacggggggctacagctcagcactgcacatctccctggcctgtgttggagtctctggccagtgaggggtggttccctctcctctggacctttgtgcatcaatctcagctgaggaggccctgtttgtttcctgagtttttctgcccacaagagccccataaaagtgagtgtggggccaccatggggacagatgtgggggttaccttgagcaggcaggactccaggtgcaaagatgccgggtccctagagaggggtcccagccagcgccgccctctgggtgccgggagctgatcccgagaggcttgttttccaggagacgtgctcaggatggagcggtctctgatgttccgtttcccattcgcatccacgagcagggattcagattaactcactagaaactcaataacccaagagaacaggctcgtctggatgaaaacctccacttcacttcagattcctgacaagaaaggccatggtgatgacaacagcactgacgtcctcatgggttcacttccaggctccgtccacacatgtctctccatctccaaataattcttcccctcccactttgtgggtgaaggacttaagtctcagagagggtagtgacctgctgctcaggtctgagttggtggcagtgccctgtgtgagctttggggacccttgttcccaccacagagtgtccatggagcagcatgacttctggaagggcgtctttatggaacacctccacgtttccgtggagagatttcctgtagcccgtggccccggcatccacgtttccgtggagacttttcctgtagcctgtggccccggcatccacgtttccgtggagagtttcctgtagcacgtggctccggcatccacgtttccgtggagacttttcctgtagcccgtggccccggcatccatgtttccgtggagagttttcctgtagcacgtggctccggcatccacgtttccgtggagagttttcctgtagcctgtggccccggcatccacgtttccgtggagagatttcctgtagcccgtggccccggcatccacgtttccgtggagacttttcctgtagcccgtggccccggcatccatgtttccgtggagagttttcctgtggcacgtggccccggcatccacgtttccgtggagagttttcctgtagcccatggccccggcatccacgtttccgtggagacttttcctgtagcccgtggccccggcatccacgtttccatggagacttttcctgtagcctgtggccccggcatccatgtttccgtggagagttttcctgtagcacgtggctccggcatccacgtttccgtggagagttttcctgtagcctgtggccccggcatccacgtttccgtggagagttttcctgtggcacgtggccccggcatccacgtttctgtggagagttttcctgtggcacgtggccccggcatccacgtttccgtggagacttttcctgtagcctgtggccccggcatccacgtttccgtggagagttttcctgtggcacgtggccccggcatgttgtttgggtgcatggggacttaatgtgctgctagagatgctgattgagcagagcctacagacaggagagctttgtctggggtggagcctactgagcccatggggcagggtttggccatacacaggccccagtaggggaccaagagggccacaggagaagaactggcataccttactgggcttctagtagtgatagccgtttgctgccaagacatttcctaggagagggaggctatcatgtcaaggttgagccgggtcctcaggcccttgtaaaggagggtctacgcttgggggtttgtggttacttgtgtgctctgtacccaggggtatggtgcacaggtttcaccgggtgccattctgctcttttgcccagagaagctcagcggctttgctgcctcagggaggcaggagtggctctttggaggagcagttgatccccgggatgctagtgctctgcctgagcagatgtggggcctcagggcctcaggacttcagagcccagggctgactgacctagggacaggagtgtaagggatgtgggcaacgaagaattccacagggctgtatttccagactcccatgggtgggtgtgggtggagaagccccagtgagctggttatctcccaccaaacaaaactggaggtccctttgcagagactcttgcagttcatgtccacatgacttctctgagaagcaggagagactcagcgcagaactcaggggagtcgcactcgggagaggcagcgtctcctctggagcacacagaccttatgtccttccctccagctgtcagccagacatgccccagttgtcttgcatatatacatatgtaatggtaacaaggaattctgcttgagccttgccaatcagcccagtgagcaggtttctgcagcatcttgtctcctgggatagatactcagaaagtgaaccctgtgcactttggggccttgtctctcagcttctgttgacacataagaaaagagacacacagaggaccccacgccccatcttcaaagtgtgaagcacactccccggctgatacgattcttgtcgattcacttacggaatcttccaatatgcttttcctccctataccccacatccctgtcacagagttgagaattggattacctggtgggcaggtgggccccagttagaggccgctcacaccggctcagtgcagatgaccagtggcagatgggaacccaggaggcctagagatcttgggtgatagggaagctcccgcagctccctcctcactagtccaggcaccggagcctgcggtgggagccctgtcatctcagcgacggcctgcgggtgacttacagctcaatgaggggaggcacagagtaggtgcacacagtaggtgccgaatctgagtggttttattcgttcctctgtagacctcgtattaggctgtctccttgactaccaaatctgctttcctctgtgtttatgctctggaaggtaatccgaagccctttaatgggatggaagcatttccagataagaagagggtgctgtggccagaggcacagggctgcctggggccaggagtggccagaaccctagagaagaattgcatttggggatgcacatcaaaaacacgaggaaaagaaagaaagtgggtgggaatagcgtgccttcggcagaatccaaactcacttccaaggcaaagccagggcccaacacgagaatattcatttcctgtttcattgttggttacttaatgaccttcctttgaaatgctgcagttatgtagaaagcaggttgtcatggaaacggggagtgacgtgcagggaataggtacacaatgcgtttctttgtcatgtccagctgatgcgttcagcctctgctcagacatgggaatttatgtgaggaattaaatattaactggaggcattgccctggagagaggcagaaacacagggtgacaaaagatgctggaaaccagggcaaagagcatgctggggcccccgggatcctgcgggaggcaaagctgatttgagaccatgggtggatctcactttcttcaatcaatgggctccagagaagtcgtgcaaaacaatcttctttttcaaatgcatatgtactgtgcattcttttgaggggcagaaggatctggttgtaatgcgaataattactcattagtcagctcattttcaaagttggaggggtgacatgccaagttttctcaaggtggctctcagctgccttgtcccagcactctgctggccgtggttgtcagtgggaaccaacacctagagctgggacaacagtgcaggggactgcaggaagactccagggaggccccaagtcagagagaaattgtctcttgttcctgaagcagccatggagccatgaccttgtctgtttctccggtggattccaggaaataggcattgaatatatgatgttaaaaaagtgcctcaagtttctcactttctccccttgagccagcacggctggcacccaccaagctttccttttctgaccttgaacctttttaaaccctcagaaaatgagttccgaggtgagctgttaaatcagaggtggacacacggaggcaaggccagcagctgcaggacctcaagacacctgggcagacactgcaaggtgagacgtgagagggcagcccctgtcgtagggccccaccccatggctgcctgcacaaagcctctcttcagctgcaggcatgaagcatggaggcgacttttggtctgatcctcaccagagtccgggttaggtgaagggtaaatggggactaggatcagcaatgatccggtcactttaaaattaagggaagaaaaatgactctgagtagatcaaaactaaaatgtgaccccaggctgggcccggtggctcacacctgtaatcccagcactttgggaggctgaggcaggtggatcacttgaggtcaagagttcaagaccagcctggccaacatggtgaaaccccgtctttactaaaaacacaaaaattagccgggcatggtggcatgcgcctgtaatcccagctatttgggggaggatcccagctaaggtgggaggatcacttgagcctgggaagtcaaggctgcagtgagctgagattgtgccactgcactccagcctgggtgcagatcttatctcagaagtaaagggactaggaatggtggcttttatctctaatcccagcactttgggaggctgaggcaggtggatcacttgaggtcaagagttcaagaccagcctggccaacatggtgaaaccccgtctttactaaaaacacaaaaattagccgggcatggtggcatgcgcctgtaatcccagctactggggaggctgaggcaggagaatcacttgaacctgggaggcagaggttgcagtgacccaagattgtgccactgcactccagcctgggtgacagagcaagactccatctcagaaaacaagcaagcaagcaaacaaaaaaaacccaccaaaatgaaaatgtgaccccagagtctcacttccttgctttgaggtgtgaccacgtctgggctctgtgataggcctgagcaactgttctctattcaccctgcttttacctggccaggctgagaatccctacaggatctgacagcagagattgctggcaggagcttatgaagtctgttggccttgttttatttcgatcttcctaaggggaggcagatggtgcaagcccttcttataccttcccagggtataagatctcccttcggggacactcccgaactgtgacatcacatgtgcttacagccactgttctccaccaccaaccctctaattctagaacttcccaccaatactctctggatgaggccaggtccccagggtcaggtgaccctcacagctggaagtagaggctgacaataggcttaggctgaagcccttcccagagatccgattctgacctctcttttttcttttttgcatgtagatgctctccagcaaggatccagctgtgactcagggcatggctcaaggacagtgatggcgtagggtgtaggcaaggagggctatgcagttgtagtgggaacttcatttgggggtgcttgtgttttactctcaaaacccaacctttttcttttgaatctggtggcgagaatgtacattttaatgggtctgttatagacaacttgctgagcacctccgctcatattttggctcccgcaggattatcagtgctctgctgatccatgttggagcctggggcacaaggaagagtcagtaatatggatcctgtctttatttaaggttttggtatcttgtttattaggggttttttgcatcatgttgatgtttctaaatattgaattaaaatattatttatcttgatcattgagtttttggcctcattcccctcaccctaccccagatcctgaggattcacatagcgctgtactggcatgagatcatgtgagcatgaacgttacttgacttgaggccaggggctctgcatgcagcgttatctacaaatgtctggtgccatgtcaggggtgggtcggaagacttttgtctccccctggcccagacatgacaaactcagagagtttgggacctaccatgacaacccatggctgttcaaagtgctgcttctgtgaacaaagccagggacccgtgcccaggttctcgtggcatcaccagctctttcatcactgctctgtttgagggtcatttcccttcttttcttgcagatagggccgagtgactgctctgaatagagaagctaagatgaaaagtgtgccagagaaggcgagaggatgagaaagggtcgactgcctagaggacagtggggcagcaggtgcaagtagaatctcctgactaagaggctgaggagggtggcagcagagggcataagccgtggtcacagtgtgagaatgtcacacagccacagcagcatcggggtcagccttccagaggctggcttcggacaggagatgggtggtgaggagccagcatgggagggcagtgaacacacaaaccctgtgcatgggaccgtcacagcctgcggcgtgcctctgagttcagcaccaggcatgtggacagctcaggaccggttggaaggggctgccagaagtcaggtggtcgtgtgtcggggtatgcaggagctgatggtagctcctcaacccccttcttgccaaatattcagagatatggaatcaaggaaaagatcagttgcatggccattcagccaacccttcttcctgccacccagggcaggaggtgcctctggcaaggactactggacagaggctcctgcaagggaaggagctgccactgggtatggcccttctggcctctctttatgttgttggattctaccctgggtgggtataaattccatttatgctggagtttttaacagacggttgcagatatggctgcttcatcagggtatccattatgtagctctaatttttgatttgggaatgaagtgagccagtatcccatgcttagagctgtcaagagaaccccttctcagacatgtgttaaataatgccccatggaggtgtcctttctataccccaaggaggaggctggtctattctgctgaatttgttgggagaatttcagaatttcagacatgcaacaggacatcacccaatgtgaggacagaactatctctgcaaggaaccaagggtactgtgatggctgccagtggggatcaggggtgagggcatatggtttagcctcagagatcaagagagtggaaagcaggatgtgtgctgaggtcaccgactttctatatctgttctgtgggctgagctggcaggcaggtccatgcaccaaagaaagggaaggggagggctgtggatgcagcagaagatcctcctgggatactcgggaggggagcaacacaaatgcttgaatgctgctcttagatcgttgagtgggagcttggatcttccacaatactgtctgctgtaatggcttcacagcagtgacagggaagttgatgctgccctcagtacataaatgagagaagaaaacaggccagaccatggctctgtctttctcccctcccctcactgcagagaagtgagactgaatgtggtgtgaggtactgctggagccaggcagggtaggggacagccagtttctggccacctcctcaccccccactcttcactggccccttccttctgggaagtggctgcctatggtccgctgggactcagcaggtgctcttcctcttcttctaggtctctgggaggaaaaccattatgcaagaggctcaaccgtcccaccgagacactataacctatgtaattttatggatttttaaagaatagttgtaagtccattctaattctccagatttgctggctgtcagaacacattttaaataaaataaaacactaccgtgtctccttctctggcccagcgctggggtgaatggcccccgtggtgtcagaatgcccggaaccccccagctcagcgttcccacatatggcctctctgcagcccctctgaccacggctctccacacaccccagccccagggtttcagagatgtttctgactgtccccatttattcattcatccacctgtccatccacccatccttaaatgacatgcactaagcagctgtctggaggagagacaatgaccttacaaccatgaatgaatgagctcatttcagattgagatgaggactgtgagggaaacaaacaggcacaaggtggagactgagaggagctgggaagaggcagggtgctggccacctaagaatgctcccagctctacctctggagtgcctcccaccccagatgtcctcaggtcactgatccattcaccctccccatccctacctggctctcaacccttagcagagctctctgtttcttgaactctcccctgagcactccctgcctccctggggtgatgtacaaatcttggaatgccaggctggtgcccctcagggccagaacagctcctgctggggccaggacaccctcctgctggggccaggcttcagccaggattctgtcctttgactggccctgggccattggtgcagaagggatgtgatgggggttgagggaggaagctgttcagctctgagggccctgtcctgggaggaagcatgaaaaaggaatgaaagaggcagagagagacagagagggagtccgtgagtgagtgaggagaaatgggtaaccctgagctggggcccgggaaggagtggggagacgcagcctctgggggcaaaggtggaagttggcacaaagcccgttgggcttcatggaaaatctccaaccctgatatctttggaagctgagtctaccatttccccttagaggttagacacgagtggtttgttactggctatgtgtctgggttcttttcattttttattttttttgagacggagtcttgctctgtcacccaggctggagtgcagtggcgtgttctcagctcacctcaacctttgcctcgggggttcaggtgattctcctgcctcagcctcccaggtagctgggactacaggcggccgccaccacacccggctaatttttgtatttttagtagagtcaggtttcaccatgcctgcctcggcctcccaaagtgctgggattacaggcgtgagccaccatgcccggccctgtttctgggttctgagtggatttgttacagctgcagcctcagcgcagatccctctaggtttcaagattgcttactgcattggcttgttttggttcctgagtttgtaaacacccaactcagggcactctgttttggccaggccagcatgcagatgagtctggaaaaggggctggtcttcgtaccatgtcatggtgagaactgtgtgtgtgtgtgtgtgtgtgtgtgtgtgtgtgtgtgtgtgtatacttttttttttttgagacggagtctcactctgtcgcctaggctggagtgcagtggtgcaatctcagctcactgcaacctccacctcctgggttcaagtgatcctcctgcctcagcctcccaagtagctgagactacaggcgtgcaccaccacacccaactaatttttgtattttcagtagagatggggtttcaccctgttggccaggcttgtcatgaactcctgacctcaagtgatccacccgcctcagcctcttaaagtgctgggattacagacgtgagccaccgtgcccagccagaaccatgtatattttcaaaagagcttacatgattaatcctgactttactaaacagaaatataaaacagaacaaagcaaaaacacacttttgaggagactgcttttatatggcactaagaaagcaagttaaatggatggacaaagagacagttctcttgggttaatttggcaatatacaatgtatttgcatttatgaattattctcctccccacagttttcatggttttcctatcgaaggcagaactattgaaatattaattagagcctcaagacatgctcgcagtggcagaatgaagctggcatttggagaaacagagcagacgttcttgagaaaggttgccggcccagcagtaagagtgggtgatggggtcgttctgccttttcactctcaaggggagaggtcaccgggctatctgtgggttgcgcaaaaaagggacctggttggcttgtgtttggaacaagtaaagtgtgttttaaaaatcaatgaaaaattgagaagtgtttaattttctttgcatcattgagctgccctttagggcccagctgtcattgtgtggtgggggcagaaggtctggggggctgccgtccagggatcaccaaggtgagcctgggtggtgctgggcacagggccgcccccagcacccgctctccatctaccacatcgtggtgccgatcttgcggcaggaggagagcagagaactcacctctgaagtgctttgacttctttcgaaaagaaaagtgatgtaaatcaagcagtgctggttttgtccagatgctttcgcgtcagccggcactgctgatttcaaatagctcagaaaccagtgtcccaagtcacccagctcttacgggttcattctcgtattaaagagcctggtttattttttcttcggtagttcagtttttttccctttaaaaatcaaagctacacgctcctaagagaacttctcgcttattgaccagtcaatgcagataaattgcaaatggtaaaaaggtgctcagcagaaggagcggcagagctgtcagcttcatcaacgggagctcacagttttcaagcagtgcccattacacatccctgcaaccctctctattctctgctctttgaataatttatctgcaggaaatccaaattgccaaggcacgctttaacctagcagaatgcttgccaatatccttgggaaaactggcaataaataaataaataaataaagccgtagattgcatttcagctgagtgcaggcaccgcacaagtcccattgtacgtcctgcatcggaaggcattgcacacgggctcagagcagacgacatttgaaggctcataaatgtaatgaagtccctgtgacacctgctcctctattcactttaaatgtgagccatttgtccatggggaacctccgctttaaaaatagaaattgtagtaattgtcttccgttctattggaaggctgtaataaacgcacggctcacagcactgtgctccacagcctggagtcggcaggttgcataaattacccaggttttgatttttcttccttaacaaatcacatacatcattgtatgttagtgctgctgcatgggggaggttcaatttgcaaatttcatcttactaattgggggaattcctttttctttcttcccaggtggttctgtagacatttgtctctttttctggctttcaggagcaaaagccccatttaagacgtgggggcttctgagccccctcctgctgcctctcttcctttcttctgctacttctttccactcccctgctttccctttgactacctcacgcatagagccctggcagctctggtgtctgtggcctgggacaggtgtggatttgctgcctccccttcctgaccacaggtgatggtggtggagtccagtgctctcctcttgggcctcccctgtccggctagaggtgccctcccccgcctggtgtggctccccgggaaggatgttttgcatagcatggagtgtgtaggatttacttgcctgcccagatttgtcatgagtgacacaggacaaggatgctgtgtgtgaccctcaccactgccccacatgtcctttctgtgattgtcaccctcctgggggctcccccatgactccctcgccggacaatgctgtgggcagtgtccccacagagggtggtcagattcaaggatcacaggtggggagggacaccgataggctcaggcaaggcagccaggccctcgaggcctggagaacatatgggctggggccgctccaggttgcctgtttctcacgggatgaccctggtgcgtgaggggcattaaagccttctgctgggccgggcgcggtggctcacgcctgtaatcccagcactttgggaggccgagacgggcggatcacgaggtcaggagatcgagaccgtcctggctaacacggtgaaaccccgtctctactaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagccttctgctgtagtgggaagaaagggcccatgggaagctgtgctctggggacacgttggggtcagaagccactggacgacccagcactgccgctggtggctgagtctgtggtgagcgacctgccctgatgcctcagcacctgcctgaccaggtgagcagtgggtgctgctctgtgtcgggccaggagaccctcttggataacatacggacattcatcaggcttcagtggcgcagggcccatgcctcagcacttgttggcaggtgcaaacctgggggcacggtgcactgtaccctccttgccaaggccggggacatgctgatgggacacttccaagccttgtagaaggtcctttctctacaccctcccacctgctgctcctggccccaggcctttcttgtcctgtgagcccatccttgtcattctgtgcccaaaatcacctttgctgtcaaagcttgagccagaaaatggccagacattcctgatggctctgtactccagaggcactggctgggttttcttgttaacgtcgtggttttttgcttgcagatgagcttagaaaatgaagacaagcgagctcgcacccgatccaaggccctgcgaggtgagtgccgccctcccctcctccagggctgtaaatgccactttcctccgcggtcttcctcaggagcacaaacccctaaccacacatgtgcagagatgccctggggacctcaggcctcttcagcctcattcatcctcagggctgctgagctttgaagctggcatctaagagggctgctgaggggcctttggcccagatgaacctgccttgagggcagaaatgttgaggtagacccagctccatggagtgggagtagcaaggctcagttacgagaccattctgtttggaaatgagaggccgccagccttccaccgccagcccccttccttcccaggcgatcagtcttggtgctaatggggcataggaggttgttgggttgagctggaagtgcagtgggaggagaggaggctgactctgttaggatctgagccccaacccctggccagacttacctccctgatacgggcgggggcttcctcttgtgcccaagcatctcaggtgtgcctgccccggtcagagccccgtgcatcttggcagccatcactgaaggaccagtaactcggtccagttgttctcttctctgtccagcttgatctggtggtttgtgtttcctgccaaaagctgacttctatctgcaattagagaaagagataccatccctggccctgaggtcccagagatcctgtctgaggtggagcatctgtcccactttgtaaaactgccaggctgctcaggggagcttctgcggcgagcaccaggcttgggggagcagctcactctgttgaccttggaggactctctgggaggtcaggaaagggtgagcgccctggggaaacggctcaggtctcactgagatttgcctccactcgtccttggcaaacctctcggctgtttaacttagtttatgctgttagggcaatgagcctttaaaatcacaattcccacatgttttccctgtttctgtctttttcccaggacccccagagaccacagctgcagacctcaggtaaggaagtcttcctgttagcaccaagcatcgtctatgtgcctgtgaccctggagatatcctaaatgtcccaaacggggtcttcttggattgaccaaacacccctggtgagcccctgctttccctaaggagactgcctttctcctggccacgtgtccagctatcttggccccatctctatctgttctcacctctgtcctggccccatcatgtggcgcaccagcatcatggcaaggacacggatgtgcctacacctggtcaccacgaggacctggactgtcactgcggtcccccaaaccgaaaacaagccgctctcttaccggaccctcacaagtgcttctgtgtcagatggttggaggcccagttcggggatgagatgagagaaggggtcttctacatcctgagtcttccattggctcgggatgcaaacagcagttctgtgtgctgatgacccggctggctgagctctgtgaccgtttccttcctgcttctcagggatacagattctcagggcagggaccatcttactgttcagcatacaattgaagagtggatggcttctgccaatcaggaaaatgagaggactgcaaagttcactttgtaaaccttttgcagaggtgggacaggaagacagtgtccctctgacacttgaggccccgtaacttggagatgaagggggaggactacgggagggagttggggtgctgcaagccccaggctctgcgtcagtcacacatcacagtcttgatctctgggaaggtcatggaagcactgcctggtgatgttattatcctgtttgtgaagtggggaaacggactcaggggttaaccttcatctaaccagaagagctgaatcgcatgtgctacttgctggaagccccaccctgggtaacaggtgggaggggtggggtggaagctcagccaaacaggtcgtgtgccagcacttccggtctggggtcctcagcatcacaccgggtgctccccagaacacagtccccggaagcacaggggtcggctccctggaagggagacattgcctgcttggccagcctgctgaagaagcggtgattgcgacggcgagagatgctcagaaggaccccgagtaaagggaagaggaggtgccacgtggagtcgcccagggacacggtggagacaaagacggaggagaatcccaggcgagggtgcagtgagtgaggcacaggagttgaggaaactccaggcttttttggtaacagatggagtgtggaggaagtcgaaaaggcaaatacaaatggcagggtgctctcttgtagctttgaaacagcagaaggaaaagtgactctcaaatagatttgttcgtttttaaacattctgagaggacctgtccagtctaagtgaggggttctgtgagcatttggattttgacgccctcatcatgagccttgtggtctcaactgacatatttggtaatagtgagacccttaaactttttaatggagaaactaggggaaatgtgttgacatctagtgttccaacaataatttcttcagcaattcttcattgctaacatgcaatgtgatgcttagagtaaaataggacaaagattatgttccaaggaatcaaatacattctgcacggaaggtaccattcattcctgtattctcaaacatctgttggccacacgcttcacgtgggcatgcctgtggctcgtgctggctgactgcgtgccccagccatcgtgggagcatttacaccacagaaatggactgatgatgttccccctcccagagacctgtttaccagcacacgctgggctctgaccggacaagcagacgagacctctgtcctggtgggggccacaccgtgggtaccagaacaggaagcatgacccacgcagaaaacgcaccgttgtggtctgtgagaggagcatcgcgtcctgtgtgcagaccatggcactggatgagctcacagacacagagtcacctgtcgggaacccccgtgtgtcgggaacccccgcgtgtcgggaacccccgcgtgtcgggaacctctgcgtgtcgggaacccccgcgtgtcgggaacccccgcgtgtcgggaacccccgcgtgtcgggaacccctcgcgtgtcgggaacccccgcgtgtcgggaacctctgcgtgtcgggaacccctgtgtgcaggactttctctgtggatgacttaacactgcattggctcagaacttcacagcctgcagtgcccctaaccccagctcgcctccccaccagctcaggcagagctcccaggaagacagtccattggttgtttaccaggtgagctgaggagaggttggacttggatcgagcaggaccctgagctgctatttccgacctcggagcccactgggagtgcctgagcgaagaagcagtttgatggtttttcctttcaccccatcgggagaactgatgacgtttcagcttgtatttttgcctgggtccatctgttgtcacatggcctcagactggctctgccagaggcgaagactagggaaggttagggttggggttagcatctttgagacagcgaggcgctgacaacaccgagttcaggaccatctccaagttcagagagagaacacgtctgtagctcacccttcttcttctggcgccttcctccttgagccactggccaactcccacccagatgactgccccaggagagggagggaaggcagggaaggcagtgtcttcaaaggctagtagctgaagcatggggctccaggctgggattcagttcctctcctgacttgtctcctttgacgcctacttttcaagtttgggtccctcagagctgtcatgcaggatgccagctgaggggtgactgtgggccacaccctcttcccagcctcacgtgcatcctttcctcacatctctgacaccagccctagtcagagctggggagtcaaggctggggaattccctcctcccggagaaaagaggctcgggagtcctggagccctggccgtcttcctctccctacaactctggccctgagcacccagaggacatcaggaaataagagctgagtgtgcttgcaggtgaactgcagggctggcatctgctggcacgacacccttggaggccctggctgggtctcttgtccactcggctgtggggtggggagcaggcatctaaggggtttccagcttcctgtccccgagcggccttgtccgctccacgcacttgggctcacagccgtgtctcacaccctctgaggctggggccggaaggtgcaggcccaccttcctggggaccaggactcttctgagctgagggtgacgtgttcagggcagtccggtccccacaggcctccacagcagctgtcacctaattgcctgattcactcagtgatgtcatcggctaattgggaccttagcttcaaatccccattaacaaggagcttttttgtgaaaagtcccaaagctagttctccaaagagtgaaagcaagtgtgggcctggattttagaagagactagaggcagggagaggtgggtggcagcggcggcaactccctcagtttggaaagggagcccccagtcgagtgtggtgtgccctccctctctcgctctctccctcttcctccctcttcccctcccttcccgtctgggttccctcttccctcctccctccctccttccctccctctctgtcttcttgttaacacactgaaaaccccaccctggaaggctgcagagaacatccccctcccccaccccatggctgctgttgagccaggggatagggtaaggcctggattctgctgacggttctcccagaggtagtcggggagggtggcctgcaagcccactgggccccacagttgtctgcagtcaggcctgtgatcagtcgaattagaaacgatcagaggtgtctggatagagactggggatggcgttcttttccccgggtcccaggtatgggggcaccagcccttaccttcctcccttcacaggctccggaagatgtgcttgggttttggaaagagctcagactcacaatgccagtcctgttaaaagcaaggtcttcccatcttggccaggaaagcctctctcttcccacaaggagcgcaggcctgcccctcccacctgccttaggtgacctggcacaggcgtctgggtcttacaatggcagctccttgtagtccttgagccgtggatgcatccgacagcccacaggagcctgatacatggtgaactctggccttacactccacactggcccctttgtgcctgaggctgctgtgggagctgtggtcctgccgccacgttggttggcatagtcagtactcatgctcagaagtttccagagcttcctgctggtttggttatatagggagacagatgatggttaaggaagaggaactcctgggtgtcctgccttgtgcttctagggtgagagatgcaggagggtcagtgtcaccccctccccaaactgcccttcttagcacagcccaaaagtcttccacgaggcagatgctgttggttcctggttcacgggccctcccggcttcttttccctgcgtggaagctgggacccacaccagctacaggcactggtgggatcttcaccactgtctgtggcttgggccacagattcctttctgcctgtcagtcctggctccgtttgctggggcacgaaggtcacagctggcagggaatgcagagactgttaccctcgagggccataggccttatggcattagtgatggccacagagaatgccaacttctgtgctttggacttgggacctctttagagaggggtgccgtgttcagggcacctcagagcgtctcgtgtccaagctcctggaaacctggtggcagctagtggaatgcctgccgtggggagcggtctgggagactctggcgctagaagtcttgctcttatgtatacacagtctttaattgaacactcgtaaaactgtaatgagccatttatttatttgaatggggcgagttattaattttcagcaaactgcaggcagccattctgaggtgaatcgtctggagacattctgctccccagggtgaaggtctgcgacaggctctgagatctgagcccatcgcctgatgtggccttgcctttttatttcccctcagctgccccaccccaggatgcacaggctcagggcacgtccggggcaagtactccaggcaccgaaggtaagaggacccttggatctcacggagattcctgggcggtagatttggagcccctgcccactctgcagatggagaactttccatctttttccatggctcccaaggccaggctgctgacccttctgcgaggcagcgacctcccactctagcgtggagatctgtgtggccatgggcgtgccatgtgggggaagacagaccatctgacctcccgcgaggcagcgacttcccactctagcatggaggtccgtgtggccatgggcgtgccatgtgggcgaagacagaccatctgaccccctagtgctgcactttgctttttttgtccgggttccctgcaaggactggatgagtctgtggggaagggagggagggaggaccctcgggaggggctcatggggtgtctgaggcctctcgtggccctagcctggtcctctccactgcctactcctccctcccagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggtgctttgtcgctctttcttccccgaataaagggcgcttagtgtggccctggagaattgcagcctgtgagcggggaggggctcactccgggcaagagaaagcccttcctgagaacaaggcatgtcttgtcccaacatgtgctgggcttcctgggagagaggtctgcccatggtgtttatggggcctgtggtgtgtttgtgtgtgaacactgtgtgcgtaggagagaggcaggacagacagagacacggggctggtgtgtgtgtgtgcagttgtagtgtgttttggcaggtgtgtctgcatgtatatgagagagacagacaaggctgtgtctctgtgtgtctgtaagtggggaagggaggatcttagactggccctctgttctgcctggccctctgggagacctgcctgggggcatgggtgagaggtctgcgttcccctgaggtactcacaggcagatgctgaggaaacacctcaggttgagcttcaggtgattgaggaccagatggagcctctgaagacggggtgcccggggaggccaagaggggaaggaggaaagcagacgagtcccccacttccttgtggggtctaccaggactgccatgttggagctcctagcccttggcaaaagtgcatgaagcaggtgctttggcccctgggtcccggagggaggggtctgtgcccctgagagccctggcagatctgtagagacctggggtcagatgaggcccaaggtccactccccccaccatccccaccactcacccagcactccccaagcttctgcagtggggaagggtctgagatggatttcagaagcaaagccagagagggtcctcaaccccagctcccttggggggctctggagtgagtgcgctgtcccgtggaatcaacatagtcctagatcccaggtagaaaagacacacattttcctgctttcttatcaagaagggcgtctggggttcagctgtcaacctgggcttggactttcccctccgaagtaggtggatggcagggcccattcctaccactgtgggacgtgctggcccaggtgtccttgctgacaaccctacggggcctgcatgtggtgagcacctaccatatcttagtttcgttttgtttttgttttgagagagtctcactctgttgcccaggctggagtgcaggggcacgatcttgatttactgcaatctcctcctccttggttcaaggaatagctgggactacaggtgtgcaccaccacgcccagctcatttttgtatttttagtagagacagggtttcgccatgttgaccaggctggtcttgaactcgtgacctcaggtgatccgcccgcctcggcctcccaaagtcctgggattacaggcatgagccaccgagcccattcttatttactgattttcaattatgaaacaattattattatttttttaaaatctgacttgctgcttaagctccattgtatacaatgcaggtttatctgatttgggaaagtaaacgtgatgggagaggaacattaagaaaaagtatcaaagtaattcttagtttaaaaaatacatcagtggcccatgacctgcctcctaaaatatattcaccgtgatttctggattcaggcagaagggttgacagaaaggtccataccaaatccccacttctggagtttcatgtttccccttggctcccgtataaagagtgagtggtaggtcaggtggaggggtggtgggtgtgttggggactggagacctggagtcttcccacgtgctctctggcccccacgttgattttgattttgtgcaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaaggtagggctcaggggtggcctggccctgcagactcatcctttcacccctgccccaggtgtgcagatgcaggctgagagcccttctaggacagggggctgggggatggcagaaaagcagacaaaaggacaaatacatgacacagactgtggtcagatactgagcaaatgggttcccacactgctttacatagagcgatctggagcgagacacagcggagacgtgtgagaaagaaccaggtgggagagaggaggtgggagggacagtgacccacccacagtgactggtcacagcagcatctggggtctggagagggtggggaccgtcctgtcccttccaccccaactcacactcgtggcagggattgtgctatgacagaacccgctgtttcctacagccatgctgggtcatcctgatcctctcgtggggtggagaccagcaggcagatgtgaggggtgcccttgctcctcagagggagcagcctgccgctggctctgcatctgtctctggatttggctctaaagtgtgcagggtacaggggagccatcccctgatcgcacggagtggctgatgttgaggtgaggatagacaaggagggctgcttggaggggcctggggctgggctgacgtggttggggagcagctgggaagcagctgatgtggttggggagcagctgggagcctggagtgctgaggtctgaggacgaatcctgagtaaacggttacggccttcattgttactggggtgtcagggtctggacaacaggctggctctgctctgctgactgcccatctcagattcctcctgggacaggggtctggggagcagggctggccaggggctgctccctcagtgagccatgccagggaggccaggccttggacaggtcagctttgacccagccggcctggtgcggagggcctcctgcacctgggcacttggcctctattctcctaagactagggacctgccctgatctcggcctcttttttccccatgtctagtcctgcatctcttctccaggtggacgggggcagtgggagttcttggtgctcttccaatgagtgcccccaggaagagttagctgagaccagggagggagcagataaggagagagaactgggatgggagatgactcaggtgctggagccacgaaccaaaaatgcaggagacacggaattgccaaccctgggaagatgcacttgggtcatgggagagacagacctgagtgagacataattcaaggggcatgataggcaggtcagtggagacacgagggacatgttttccgggaacaccaggcatatgagacaagctcaggggaaagatgctaaggggacacaggtggggacatggtttcagggtgagatggacccaaagaatggctttgcggggacaccctttagggcaacccagatggcgggacagctctttggggacccagatttaggtcggcagtgtcatgctccggccttgtggggccatgggcacaaagagacacaggctgaaggtgagacttagggacaggtgtcaagggcccggggtggttactagcctggctgtggtgtgcttgggccgcacagatcagcgcagaatttggtgggacacatatgaggaacacagacaccaagtgacagccctaggcccaggtttttgagggtctcagacctgtgggacagacataggaggacccagatgcaaggcatcctgccttcagggatagattttcagtgcatggacccaaagggacacggccccgggtgacacaggtggccaagctgagaacaccaggcagtgcccagctgggctgtgagtgtctgtgcaacgtgaacgtgcggttctggttctgagggactgatgttggggcacagatgctgcgagaattctggacagaggccgtgggacaggggtggcaagcccaggaggccggtgttgggcacgggtttggaagcccctcaggacacccctgcctgtccacatgggtggaagtctgactcctttgaacttggggcagcagagcaagagctccttccctttggagccccctcctgggaccctcctgctctgaggtgggagttctgagtttggctctgtgacctctgcaccctcccaaaggggacagctctcgtccaaaggtgtttcactgagatgtcagctctgctctgagggtcctccgtgttcctgctggtccctatactctatagtgaccggcctggacctgcagaggctagaagaggtcgataactgagatttgggtttacatttctgcccaggcatagattagtcatgcagccttggataagttactcaactcctttgtcttcctcgttttgtcaaatcccaaggatatctcctggcaggaatattgccaaacgccttgacctctctaggcagaaggctgacccatgaggcctccacactgtcagaggagagaggaaagaggactccagcggccgtctgggttgttctccttaaaacgctgcacaaactgctatttgggattgtcagggcagcctcagggcttccgcacaggcagccagtgtgggctggtttcttcagggtctcctgactgtccagccccagtccctgttcaagctcatgggcagtctcgcctcccttctctctggacagccagagagagggttcctgagctacccctgccccctctctgctcaccacccagcttcctggctctaactgatgtgacttgtgtgttttagatccttcaagagctgagaagcgtgagatcaagtgtccaacaccaggctgtgatggcactggccacgttaccgggttgtaccctcaccaccgcagcctttctggctgtccccacaaggataggatccccccagagagtgagtagctctgtgcagcgttagccctaactgtgaagctcacgctgcctctgtggtgtttgggtggtgtctatggggaggcgtggcctgcccagggccataaccttcccctttggtttgtccagatgctcatccttacatctccccgctttcccccacaaactccctcagcccaaacttgagccctttgaggctggggccctgcaaccagcccatttgtctacctagagacgccagtccgggtcagagcccacagtaacagatcgatgggagggggacaggctagtgccatccaagctgggaagggagaggtcttcttgcagcaacctctgtgccctgaaagcttaggaagcaaatacttgttcttatgtttaggctagaagcagtaattgtgaaaattaaatttaaaggagcaaaccacagaatgagaggttttaaagctgagtctggtttctgccgcaggagggagggaccacagtggtggtggcggtggggggcatgccctgaccaggctgagggtggggagttgtgtctgcaggctcttgggggctggagctgccctgcgttgctgtgtcccccacctgcctaccaagcagcagcctttggacaaggctcctgcaccctcctcagcctgtgctccccacacagctggcgctccccagattctctgacagcctcggctccctccaccccctgttctcttacagtcttagccatgcatgagaacgtgctgaagtgccccactcctggctgcacaggccagggtcacgtgaacagcaaccgcaacacgcacagaaggtacttggactgagctgggccgtagtgggggccagggtgggggccgtggtgggggccagggtgggggccgtggtgggggccagggtgggggccgtggtgggggccagggtgggggccgtggtggggggctccacgtggggtagggcacctgggttgggcctgtgtgtccctgcctgggccgtgagcccgtgacctgggacggggctctggcctgcctggggctccctgtgtgctacccttctcccagcctgccgccctgaggagtgggtacaaggtcagggcacacctgggcggtgaggggcctttgtgagggcagagtggcaactggaggtgcagtcacccagtggtgttgctgccttaaccctacgagctcccgagagagcagggggcggcctgcagaggagggagcaatgcaccctctgtgaagagaggtacaacaaccatgtgagagccaggtgaatactttgtgtcctacccacattcagaaaacctctgcacactggctcttgctcctgagtgggaagggcagacatgaacagtaacctcggcaggccaggactgtgctctgggctgctttgtgggagttctgaggcccaggtggaagtgaagcttcccgaccaccctcgaggtgtagttgttgactggtcttctatggtgaggggggactactcctccagccttaccctaagtgccatgggtggccgtggcctcggtgggatatgctttcccccagcaggcttatgctcagctgaaaggactgccagagcttttgaggtcacttcatttgaaaagaggccagttccccattacgtcacctccctgggctggctgagggactggcgctggagctcacagttaactttattctgacagatgaagctgctgcctccgtgtcttagactgagtactttcctgggcctgtgtcatccagggtcagtgcccaggctgtggtccaagtggggccctgggctgccccagagcagctaacagaacaagcgccagagagggctgcagaatccagccctgcaagctgggaagggagaggaagggggtgagggcaagcctgtctcccagacccatgcagaggaggcatctttgcccagagctttcaaggcctttaggatatatttcatctttgtgtgtccttggcatagaatgttccaaaacagaaactgactgggcagcttgtactgtgagggctcaagaacagagccagagagaaaacccctgtcctgcagaatgacagggttattcccggctctgggcttctctggagttcacctggagttctcacatctgaatgaccttgccgtgagacacccacacacacagacacccaggacaggacaggcatggaggggaaggctcagaaacccctcctcttccttcctctagtttgtctgggtgtcccattgctgccgccgaaaaattagccaaatcccatgagaagcagcagccgcagacaggagatccttccaagagtagctccaattccgatcggatcctcaggtgagtgagatgagccacagaactgaagaggctgcctcccaaatgcctgcagagggcttctcagtctcccgcaggctgtatgtgcatgtgtgtgagtgcatgtgtgtgagtgtacgtgcatgtgagtgtacgtgcatgtgagtgtgcacatgccccgggccccccaggagcagaactgcggggcagttttggagccacacaggacagagtctcatgtctaccacattcgccagtgcctcagccaaagcgcaaactcctgcacagttgcctctgcctccgacatggggctctgcctccttggagtcgtctgatgtgaccacttgaggccccttggggattcatttgtggagatgctggtcctgtctggaaagagcagactgcaccagccaaggaccacggacgtccaggaagcaccatgagccactaatccttggccgtcctgcctgtccctccccgaccccagggatagaccccaagtcaaggaagagggtgggtgcaggctttgctccccagagtgctttgtggcccctgaggttctgagatcacagtaggtgtgtgtgaacatgtgggagcgtgtgtgtgcatgttcacacgcctgtttgtgtttgcatatgtgcgggtatgtttacatgtgcgtgcaagtccatgtgtatgtgaacacgtgggagcgtgtgtgtgcatgttcacacgcctgtttgtgttcgcatatgtgcgagtatgtttacatgtgcgtgcaagtccatgtgtgtgtgcatgtgtaaatttggctctaatcaataaggatctttcagaatgtgtcccattagtgtcccctccttccatgtggctctaagaagtaagtgccacaaataaggccagaggctcagagagttgcccaaggccaccctgcccatcctgcctggcttcaaagtctctcctctatggagctgagtccttggaccacggtacccactgtcgaagaggacacttccactgctcctgtcttcacctgcagacaccctgctccccactcccgtgaggaactagaactcacacacagctcctcctccccagctctcagacccctgttccatatctgtctcaccagacaagagtgtaggagaccccggctggggtgagcgtgaatgactgcatagccccttccactgtccgcctcctttcggggcccacctgaccccggcccttcctggcacataattggcaaagttccagccagatgatcttcgctgctcaccttggctgtgtcatgcccaggcccttccctggtctgctccagagtgttcctctgaaggtgcaattcccacacgtgggatctctgggcagagcacagagacttgccttcctgctctgtgggcatgcttgccatcccacacacaggcaccttcagccctgcaggtcccagcaggctgctttccaccagctggctctcacaatggtttgaagctgcttttttcctctatcttatttgctgttccctccagcttcctgtcagttgctaattcaatcctttccctctttgatctaaatcaccgataaaatgtcaaaccgcagatttggcccccgtgtgaggccaggcaggggtgtcaaacaggctccaactttggagactgcactccctgggactatgacctcagtttgttcacttataaaagtaggacaacaaactaagtcgctcatgaggctcaagtgacactctgccgccctcagcccatggtgaatactcactgaacgctagagagattgtggctagggtggaggaggcctcccgttaggcccttttgattctatccagcccacatttctggctatcgaactttggggtgtgaggacgggctttgcaaagcttcgttggcattgtggacaataagtgtacagattctgactgaagccttggtcaaggaagccatcaacggtggtaccaatgttaagcttattattattattattatttttagtgacagagtgtcactctgttgctcaggctggagtgcagtggtttcaatcataactcactataacctcaaactcctggtctcaagtgatcctcccacctcagcctcccgagtacctaggaatacagatgtgccatcatacctgcctattttttttgcgtttttttttttttcttttttttgtagagagggtctcactaggttgcccaagccggtttcttactcctggcttcaacagacctgccttggcctccaaaagtgcttggattatagacataagccaccatacctgacccaatgttaagtttaaagttagttttttccctcctggcctcactcttgcaacttttctatctgccactggggtcaggatccatcctggggctcccacccttcctggagaaggagaaaacacccacgtcctggtagtgttcagttcttccaggcccatcagagctggccgtggttgcagggctggcctggtggtcctctgtgctgggctctgttcttagtccacacttaagttctcgtagcacccagcaccttggaggctgtcattgtcagctccttcttaattccactgattgtacactttccagactgaagtcattgcttggtccagacaggaacaaagaaagccatggctgcttgccaggatctcctcttctctgagctgccaggttcagaagctcctctgtgcctgtgtggtcaccagcatctaccaccagtcttcctgcccctgtgccttctatgccagtttcttcgtgccatcttttgtgcatgtaaaatcctgaagtattccaagagcattagtggcagtgaactgaatgcttgcagtagctttttcgtggctgttgctgacccttccaacagttccttgagggtccacctcaacacagctttaagaagagggcagctgagggctgagtccctggctgaatgaagaagggtcaggcctggccctgaggccactcctcagaaatgcacctgatacaactagcgtctcctgtagattcctcagcttcctccttgctggggagttctaggttatgctgccttggagtgtcttgctattgtcctgggctatgctactctttggccctgcctgatactcactccagttgcagctgagctgtttgaaacctgctctcctaagttctggggaaaatcttaggccctcctctatctgatgctgtcagcaggacaggccattgattatttgagggtcctattgcttcctccctgcaggccattcttcaccggcctgctctgggagcccttgaccctgggaggtggaactctgcccagctttagtggtggaatatgcaggggtagtgtcttcctgagtctccttcctcaccagacgctgtgaggcccctgcctgggctgcagattggggttggggagggtggcacgggatccccaggtcccatctcactggctgtgcatccctgtactgcaccccaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgtaagttggggagaattgttcttgtttctcttctgtgttgctcctgggaggggcaggattcaaggggcagtggaggagggaccctctcgaggagctactagggagggaaactctaccctcatgggaggaccacgatgcaggctggaggtctcagctgtcccagtgggcactgtggtggctttcttggggcctgcatctcactcctgctgccaccttcatgttcaccattaacatttatgtgtctcctagttatttgtgaaacaaaacccagatccgttacgggcgtgtgtgtccaaagacttcagagcaaccccaccagcatggttcacactgggagacgccactctccccactgtcctcctgctacctgtttaatcccagtgcagccggctgtccatttcccagccctgcctctggggagggtcagactgtgggctgggtggggccagatgactgcggggctgggcccagtgccctggcaggaagccattgctctcctggtggggaccatcttactggatacaatgtgttatctgtgacattagtaacaaattttctgggtaattgtactgacaaaaatcattcctacaaatctttaagaacaatcctttctgtcttgtcttgtcacttactgccctaatttgtggaataagcccattagccctggaagtgcatgcgaaatggaaaagcattcagtgtacacatgagattgggagtggcatcgcggggcagatgttgtcagccccaaacatgacgtgacgagtttcctacatgagaataataaaagtactgattgatgcggctgccagtggggtgtgagcctctcttcctaactttgacagaacctgctctttaggatggaggacttcctgcctccaggcacacatgcctacttggatgagggaatgcaatggtgccagtggagagggggacctcacgataagctttccaatatatctagacctttctggatatactggtgacatcgtgattgctgagaacatcgtgcatgagagtgattttgcagctacagtacaattgctagaaaagataacattctgtgccttcatttgtcatgttcatttgagcaataatgttacttttttaaggcagtgatggttaccggggacaccaagtcagcctaaatatgggtacacccttttgagatcatgggacaaaattttcctatttgggcgatatggcaaacactcatcctattcacagaatgcttcagtttctgatagacaagttatttttgtttgaaatatcagggctgctggaatgtcttggaggcttttactccttttgcccaaattttcactgagccagaaacaagattgtctcctcagtcccctagaggagggtgggtgggagtgaggtgtgtgaggacttgggactgggacgggtggccaagcccctggcccacttcgatatagctgtgccctgggccctcccatccctcccaaagtgccccctccccactgacttgtctgcattgctgcctcttttcaagttgtatatcagcctggtgttgttccctttttgcagccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaaggttagtacatctgccacagagcctttcttgggagaggtgagttggtggaatttgcagtcaggcccacctgctctctgcacaaaatgtccctaggaatggcttgtgcctagctggcaattctcattcttaactttttctccctcctggccatggccccaaggaccgcagagcttggatgggtccaccaggagaacctggtgtgctgagtgaagggggaccaagggctgcgaacacaagttcccacgtgttaggttgtgtgcacaccatgcgcccgcgtgtctccctctgagcctgagggtggtgcacacacatgcccatgtgtttccttctgactccagggcggtgcacgtgccctgttcacacgtgtttcccgcagtcttgtggttgctgacacactctccttgctcagaggacctagtcttacccgtgtttatgacatgtcctgagggactggtttttgtgctgttgggaggcaagaggaattgtagggcccccttcatgggaaatcaggaaatggcagctggattttttccctctcgctgcctgtctgtccccgttgtcctgcttccttctatgggaaccagtgttctggactctgtacgtttgattcaaatggaccagaaggcacacatgggaagggatggaatcgctaacagatctcacctttgccattgcagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggaggtgggtgcaggcgcctgggcaagcagtcaggcggctgcagccagcttgccctgcctgaggctgttgtgatattggcttttcaaggaagcttctcctcacaggcttctggaagagcctcggggagccatcccttttcgtgaagggtccttcatcttctgagcagctgggactcaggggctcaccctctgggtgggattttcagcagcagggtcatgctgtgcccttgtctgtcaagaaggaggtggtcttctcacccctgtggagcatggtggccagcaccaacgtgggcactgtggaggcatggggaggagaaaggcatcgttcagatcccaggagttgattggggaaaagctcaggtttcttgggttttgagcctcccaccaccctgcagagctaacctgctgtccgggtaggggcagagccagtgagagagcttaggacctgggcttaggatcgcccatggtgggcagttctacgtccccgagaccaggaccaacctggcatgggtgctggaactgtggtctgggaagcaggggatccttccctttttagttccttaaaacatgtgaaagaagaatcctccgaggccacagccggttctgggctttttcccaaggaggtgtgtgtcctgaagagcaaagtccagctgtgagggcagcccagggtccaggcggcagcagccgcgtgtgtgagactagcaggcccctctccctctccttcccctcccccaaagcccctcaggaggtggaaggggtccctgtggaaggagcagggccagaccctcaaggaggaatgaggggggtggggctaggcccctatgaagggtgggggctggatcaggcccctatgaagggtaggggctggatcaggcccctatgaagggtgggggctggatcaggcccctatgaagggtgggggctggatcaggcccctatgaagggtgggggctggatcaggccccctccacaatccggcctcagtgggaggcagacttccttaccggccctcacaccaccctcaggtcaccccatttcatagacgagcagcctgggaacccacaacgaggtccaattatccgaagactgttattatgctgggctgtgggcttcacgggcatttcctcatttgacccccaaaaacctttgaggggctgctgttatctcaagttggacagagtggcacctgggccccaagagcctgagccacttgcctgggacacatgcgagtgcctgtcaggacaggattttgagctctggttacagcatcctgcagaatgttggccttctgacccttcctggacccctggcccctccgtgggagggactacgccctgcttatctgtgtccacagctctgagcctccatacccagcattcagttcgaagcctttatcaagcacctgctgtggtcaaggcatcgcactggtgggcgtgtcgggccaggtggtttcgaggttactgcgattgttgtaatttgtatgttattaccctcgttgtgccatctcatcttcatggcatttcggtaacacttatttagtgcctactgtctattgagtgccatccctggctctgaagggaactgtatcctgatgtttacgctgcggagtgatgtggcggagggaggccagggagggtgtcaggagcctgccacactgggcagcaccaggcctcatttctagggcaacgcaggacctctggctgaagcaggggagggatccagcccctcaggggtgttgtcttctgtgttttgctggggggagttaagtcttcctcccttatccagaagataggagactccgggagatgcttctgtggacactgtcctgaagggtccctctccctcgcccactgggttgggcgcccaggcctccccgccagccggttaaaacatcttcctgctggttttttgcagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacgtaagtccctgtttggctggcacagctcctaggggaccctctgtggcctggggaggaacaggccctggtcccaacccatgacgaccgggtctgctcaggctttccccgacctgtcctgaccacctcgagccaggcagcctgtgacaggagccagggtattcagaggtttcccaacacctttgtgttgtgctgggctttactgcaatcttctaaaagtgattaagaacaaagaaatcccctggccaagctcaccaagcaggacagagcagggcaggggcagagtggaggagagctcctcagagagctctgcaggaagccctcggggcacccagaggcctggccctctccctgaggccgcagctgggcacgttctgccctgggctccatggccaaggcctggaatgtactgccttagggctcaccaccctcaactctgtcagcctggctggcccagaggctgcgtgtctgagctggtccgcatggggttggaacagacagagttgctgatggatatgaatcagatgtcaatgaccttctggtcagccttcattgccagccacctgtcctaggggactgtgagaggctgtgcctggcacctgctccacaggtgatccagctctcacatgtgctcagagtacatttctggggtccctcttctccccaacctgaacccctcttgtaccctcacacttgtagcttgccctcctgggagtggctggatccagggaaggccttgcttcagggcctggagaagggaaggagctcctctgcctaaatattcgtgggcacatacacgtgcacacacagcacatgtgcgtcagaggcatcctaactttaagctcaactttaatttggttactttttcttcttgagttaagttgtgtgggagaaacttccagcctgagaggcaccggctgtcctccaaggactgagtggaggaggggccaccgcttggctcgcgggtgagccaggagtgggcaccagtctccctcgcagagcaggctcagcctggggggcaggtacacaccactctccggtctgacactctttttcctttgtccagctgtcccacccctggctgtgacggcagcggccacatcaccgggaactacgcctcccaccgcaggtttgtctcctgctcgggtccgtctggcctgggtgcttcgtggtgggtcttcctcctctcctcctcctctgctctccctctttggcttaccccaatatcccatctcttctctttcagcctctctggttgccctcttgctgacaagagcctcagaaacctcatggctgcccactctgctgacctcaagtatgtttgcgctccctgacctcctgtctcttgggcggcaccctcgctttgctctccttccatgaggctcctgccaaaatcagccttctccaaggtgccaagcctcagctggccccagctctcctgagatgggcagaggggcagggccgtggaggggccgattctgcttggctggggctgctctgcctgtgtgcacctgctctgagctctgctgtttgcctctccgctgggggctaggggtcgctgcaggctcctgcgctgctcttgacccatcccccaccctccagcctctcctgaagatccccgacagggctgtctgggcctgctttcttactgccctagagatttgggaaaagcccagaaccgaccagggaacgtaagccctgccgtggctcggcaggccacaggctgtgcggctcttgctaaatgaactgaacgctgataatgaagagaaagctccttcccctcccctctcctgtcacgctccagctgcttctgccttggccctgatgccctccccccatgctcatgccttctctttgctgggctcacccgtttctgcttctgtacctccctgcccctacctaacacatgggcagggcaggccctgcaggcaccagctatagcttgctggacagtcctgcacaaccaggcgcaagcacccagaggtttccaggggtcagtgtcctcctggggctggagtcagggactgttactgcctttggttttcatgcctccagttgtgctgtgactcctcagcctgtgtgaccctgagccatggggagctcctcctgggcaccggggccgagctgaggccttggaggaagggggtcccattcttgtctcctcaggtcacctctctccaggggtgtccctccctcccataggcctctgtgttgggggccctgaatccaggtcaacacaccctggcttattccattctggggccagacaggatcctgggcactggtgcctctaagatgaggaaatgaacttgctgaaggcttctagggaccttggctggctcagacctggacagaaagctctaggtctcccagagcccccaccagcagccttgtctctgttcccctctggaggctggtctggccccagcagccaggaggagtgtgtcatgaggcccttcagttcccacagagtggggtgcagcatctaagtttccttcctggaagttaatagcttcaacataagcattttctgaggctgagatcaccacagcagctgcacacattgacttattcattcattctgccgcccactttgtctagtcctagaaacccaggaaacactcagtcctgcagcttctgggactgtcctctctccctctttccttcttctcttgccatctttcttgcattcctttttccttttccaattctgctttcttttccgtgattagtctccatggtttttcccatttgggcctgaataatttaagaggagaaatgtggctgcaggcactcagtggccccaaatgtcaccatgtcctttctgtcctgtgaagtggatgcttgggcggatgaaaggagcttggcacagttcgggcctggagacatggccgtctgggagagttagtgcttttttaagactaagagcctgtgaagaaccttaacgccaaacttctttagaaataacgaccaaaagcctcccctgtgtgaaagtgaaccgctcatcagcatcagcagggtttgggcaggcagccacggcctccaggctccttcagaaactccactctcccccaggggcctttccatgggaggccacttcctttcctccctccgaccactgcatgagcttgggacgatggtggtctccccccgccacgtgtcctggtgtaccaacctccttgctctctgccacctcctgtgtgaggcggcatcgggcactggcccctcctgatcagcctcgtggcagccatgggtgacggtggccttgggacaaacgaggttcctttcatgacttccctgtccgcacctggctgcagcgacagtcagatgatgtgtgttctgtgttttaagtgaatcccaagggcgttcactcttccctcccatgtgtctgatgtggtcaagggctgtgaggacatggccgcctcgggccactcagctcatcttgtgttgggagttgagctgcaaccacacacacctgccagggcatgacaggctttgtgcagggtgaagaatgcctgtccacagcacggggatggggcttagagaggtgagacctggtgtgtattgccaaggtagagggtgcccctcagacacggtgttcccttctgcccagatggggcactcagaagcaggtggtgggaggggtggatgtggctccagattcctgcagctgaccctgggggtccacagagccatgaggggcatgcagaggggacacctgctcctctgactatgtgagtactttcctctctgggacacaactcttgagaaaagccattgaatcgggccttagtgaggactgcaggatggccccccctgtgtgttaggtactgccggccccttgggagttatacccccacctgagactcactcacagatgccatcgggaagtatctcctctgctgttgatgccactcacagtccaatgctgtgcttatccccgttgaggcctagagctgctgtgggtctgtcactctggccacctgagtggccacttgcccaccgcactgaacctgagctctacctgatgctttgctgccactgagacaaggagctggagccccaagtggccacttgaacagctgccaacccaggaaggagaggcaggccatcttcagttctcttggctggccagcaaggtatccaatgtgtggcccacagggcaaggatgaaggaatgtgaggctccccaggagggcaccccaaaaaaactcctaggggccgaagagaaggttgcaagaggtggggccagccctgctgtgccgccacagccctttgggtgccaggctgtgcccggcttcatcttcctccaagcgaggagatgtcctgtcccagtggccggatgtcacatgtgctggtggaagactccggtgaggaagggccagcagcatggaaagtgagacgtcctccctggggtctgagcaccactgcaaagtgcctttgagcagcaggtgatctggacacaagcactgaactcttgcctggctcctgcagggtcaggggtcaggaggggtgaggcacagagagcaggcctgacgggggatggatctacccgcagaatcaggtcacctcctcccactctctaacatcagcaggaactcacatattttttcctcagtggacattcggaagaaaataacatccgtgcttgtaatattaaagtggaattttgtaccaccttatgtgatacattcgtcaaatagttttgggtgtgtaaagttggacttttgtgtttctcctccttactctctgctgtaagccactggctgtgtgaactctgcagtcatgctatacaacagccaggcctggcatggccagcgccatctgctctgcagcaggtgtgcaaaaaggcctctgttcatttaccagcccatggtggccacgctttgtgagggcaagctcccagcccatccaagaagatgaactggtcttaggctgtgcttcaagttatggctcagatatgctctgaatgcctttagtccagaccggaccctacagaagtccaagctgggagcccttcgtgtccttggctgcagtggaccctgtaggcctgtcccagtgcccaggtttggtgtctgggtgtaaaccgatgctggagcagcagttggctgctctcctctcagacttcctggtctccctcggggagacgggggagcaaagcactgaacccctgagatgatcgcatcagacccctgttgctggcagtcggcagccggggtgaacatcggcgatgctcctctgcggacaagggaatgtgggtgggcgcactcaagggctgagcccagaaggctttcctctgggggtcccagggctctgggccggggctaaacgccttcacgggctcccgttccagttctgcttccctctgcaggtgccccacgcccggctgtgacggctctggccacatcacagggaactacgcttcacaccggaggtgagcctgccacaccctcaggtcctgggccccaggggtgggcagggagtctcttccttatatgaagattagaagacactaatgttgctgacagctagagtccattcccatctctttaatctgaattgttgccatttccagaacctgattaagttgtcctctgcagtaagataaaaagacaaggggtcagggctaggggctcgtggtaatgcttctccttcccgaccctgctgcctcgtgtgaaggctgtgtctgtggattctgcttcttacaactgacccatcggttgccctcactccctcccaccccaccctggggtcacagagcttgaggggagagggtgagatgaacgggtgtgagaagctgcggttccagcactaaggtggccttttttcctctttcgaaatcagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgccaactttcgtttctttcatttttatggaagctctcatacgctacacgttgatacctgtgaagataggagccctggatgtcgcgtggagggcatgggtgccagattttctgggcttttcaggtctggagtatttgacggggctgggagaggcagagcacccttctacctatgtcttagggccacctgggagtgggccccagggccttgcaacctgcagaatttgtctggcaggaaaggtgagatgcaggagtcaaggaggagaaggtggttagaacaatgttgaagctccaaatcccatgtgtccatccacccacacacctgtgcagagagctggtagattgagagagccaggaggatctaaactgggagccagacactgttgggtgaaggaaagaggacatcttgggccttaagtgacccaagtccttgaggagaaaagattctcctctattgctcttctcactggggcagggtgggggctcgtgtgtctttgtggggcttataggtgaaccctgactctgtgtgttatcctacttggtgggggtttgtgtccttacaagcttattctcccaatagggaacgggtcccctgcactgcccacttttaggtggggggaatgctttgctacagactcagaccaggtgacccactggccattttgcccaggaccgaggtactttcagagctgacatctggcaaaatgggcagtgggttccccagcaggtgagcagagtggaaatgatggctctggacaccttgttgcccagggttaggggccggctcggtcgggacggggccctactatgcccgcaggaagcaggttgccctcgttgtgttacctgctgggccaagagcagccagacctcacgcccggggaggggcaacttggcctgagattgggttgctcctcctggtagtttgctccagctgtgcccaaacacccggccacactggaggagcctaattgaccaacatcacatccttcagacggggatgggcccaccagctgtttggtgtaataggctgtggcttgtttatttatttaatttttacaataaaactgtaatgaatgctaaattaacaatgcaaaattttggttgttagtactatgaaggtcgcacactaaatgctgaggtggataaaaagcattttgcccctgagaatccaggaatttgcctatgatcatataagtgcaacacctttatggatttggcaaggatcctgctggcagggatattataagtgaatcgtgctgcatttgcaaatgattaaaatcaagatcagcatttttcaaattaaccaggaaaaatggttttcctttctaatgtgctgtcaactgagctttaaaaaaaaacaagagttctgcagccgagtggagactgtgactttcagaaacacttcagcatttgcaggatagaggaaggtcctagaggctccatggcagagggaacctgactactgaaccctccgttttacagggttccttcccagccataaactttaactgcacttgtaattgcctagcatatttaaacagatgcatatcaaagcagaaactggaatggatgtgtcaggtcatgctgagggatgggatttcgtcagcatgcatgagctgtgatttggggagcctggtggaacaggagtcctttttatgatatctcctgcctgcgctatttaaaattaagtcacatcaggcgcttggtggtaaatccctttgccacagctttataactggtcataaaagtcttgcggaggttccagcatgggagtcaagaggtgaatgctccccttgccctgcccactgtccctggaggggacttctggtcctggccatgtttctcatgtcactggcacacacggcttctgccccccaacacgtgataggaaacactagctcacccaagaagcacagaggcctcaccagctcagtgcctgcccccaccgccccagcacctctcaacatgatgtccctgacagcttgaaagtctccacaccaggttttgtgagaaagagaacatacctgaaatctgaaatcctctccatgtatgcgattcaagggaacaaaaacagtttcccttgatgaaggggagtagtgttttgcaagaaagggagtgaaaataactcagatttgggccgggcactgtggctcatgcctgtaatcccagcactttaggaggctgaggcgggtggatcacctgaggtcaggagttcgagaccagcccggccaacatggtgaaacctcatctctactaaaaatacaaaaatcagccgggcgtggtggcgggcgcctgtaatcccagctactcgggaggctgaggcaggagaatcgcttgaagccgggaggcggaggttgcagtgagccaagattgtgccactgcactccggcctgggcaacaagagcgagactccatctcaaaaatactactactactactaataataattcagattcgactgtgtagagtagctgaagagccagccaccccccatttggccacagagcctcttcccagccagtctgtgcctggtgcaggtgtcccccagggtcccatggctgggccatccccatcagaggggggctggacattgaatgtgaacttcccaaagctcccataggggcccctggcagtgtctctgctctggacggggatgaggtgacctcggactggctcagggaatgtcctaaaagtttctgagggccaggtgggtgggatgagtaacaaagggaaaagaaccaagagaggggcctgtggagagagagaaagcagggtcctggccgagttggctgggaagggtctgaaacggcagcttcagagacgaggccagagtgtgggggcaaggagccggacgctgccctccctgtccaggccttgttgaccttccactgggcagcgcagccctgagccgcctctcacccctacggcgggagcctctgcccccgcccccgccccctgctaccgtcctcccgagcgcttcctgcgctgacagtgacttccctgtatgcccatgaatctcctcgtaaatggagccatggtgacctctcggggtcttgtgttgccaggtaatcagcacacagggagtgtgtgacaaacggtaatttggatgagtttcatttatgaagagataagaatgagccttgcagattgaagatcttgtcctgggtttggcgtgggttcctggatgacgtggtccctcagctccccaagtcctggtccaggtccttccctgaggcagtggggacagacactcagagaggtcatgggcctgggccctctgcgctgtcctgtttgtctctgacccacactgagcccaaggcatttgccaatctgaatttatgttattttcataagggcctctatccctctcctggaacacccagaacgaaggaaaggaaaacaccatttaaggccagcctcaggcacgagtgattatgggtagcgagtctcccccacatgaggtctgcgttcttccttctagaacatagatctcagtggtggcaaagctgcaacatctatgggcattgccccctgattgcactggcctcagtctgggaggctgtggggtgacaggcctctgctgtccctgagctcccctgcttaggggaccttgtcattcttttgtgatccataggcccccaggcctatgcttgatgcaagctcccagggagtggcctctaggtggtctcagctgacaacatggctccacattgctgagtgacacacaagtgactccagcagcaaggcttggagggaacctgagagcagcccccaggcccagggtcacggctgctggagggcacggaaagaaggtggctgtggagaccccagtcatgcaggggctgtgaggccaaagcggaagagggagcgtggcccgggtcttcacactcagcccggaagggccagttcttccctgaggctccaggacctcagcggccctccctgcctcactcagaagccctttaacggctctgagttgggctccccttgtgtctggcttgagagagtctccaggcttctcctcccaacccttcgcccctgtactcaccccggcctctctgtacccaggtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggaggtaactgtgcctgcaggtcctgcccctctgtgcagtcagtagggaccctcgcctggggcctggggctgaagctcctgagggagggccagaccagggctccgtgtgaccagagttgctcaagggaaaggccaggccacatgggtagcggatgggggaggctagcgggtctgttggtgccaggtgatgctgtgggttatgtcttcgccatgcgtctcccctcatacgccacccttccacatcctgatggagtccttcctggctgggtgttatgctggacacagaggccacacatgagcagagccctgggtctgacacttacgttctcttaacaggctgacaacttctcaggaaaagtttgtctcctacaccttatgccctgtccctcccattcataccttctcaggaaaagtttgtctcctacaccttatgccctgtccgtcccattcatgcctcttctttgaactctgggcagagacccctgcctgccttgcaagggagctggtaacccctctctgtcaggcagtgggcctgggcagcattcaccaactctcgcctgccctccaacacctgctccagagccgaaggaccttgcttcaccagccccacttcctgtctgtgtcctatggtgacaatgagtgcctggtcccatcagaaaccctgtgtctgggcctagggccaatgctgactcttcattccctcccctgtccctcccctccccttcttccctcctccttcccctcccttctccctcctttcctcttctccctcccttcctccttccctttccctcccctctcccctttcctcccctctcccttcccctatccctccccctttccttctttcccctcccttccccttcccctcccctctccttccttcctctcccctctcccttcccttttgcctcctctcccctccccttcccctcccctccccttcccctcccctctcctacccctcccctcccttccctctgcccaccccccacctcccccactccctccccaccccctctcctccccttcttcctctcccctcccctcccccctcaccttccccttcccttcccccaccttcctccccttctcttctttttcttcccctcccctcccttttcccttccttcctccatctacaagattaattaactcactcattcaacaaaagcatttgcaccatgtaccaagccttggagagagagcagagaaaaaaaggacaactaccccttatccttgtagagtgcattttgggcagagtaggtgggacagcctgtaaacaaataaatacgtaaattacttagtatggtgaatggtggtgcgtgtgctgggcaaaaaagaagcagggaagaggacaaggaagtcctctttgagaaggaagtagcagcttggcctgaggtgtctggggcacaagccctcagcgaagtggctggagctgggaacagcctggcccgctggacaaggttggaggtgctgagggcctggagccagggagagggagcaaaagagatgaggtagaaagttctaagccagggcttatctggctgcccgctggcaaggactcagctttcactgtgagtgagggccctggcagaaggcagaggagagactagatctggcatgggcagctggcatggacacagctgcagaagccgggaaggccactaaaggagactactgcagccggggtcagttgggcagagacttatgctgggcttcctaaggacatcttaccttgcctcaatcaacctttacttatggtgtggatacaatcacttcataaatgaaatcatgcttgagaatgcacaattgtaatgcatttttctgcttgagtgtctatatccgaggagtgatctgtgactgtcattatcaccacagcctagagggtatctcagaggcagacgcagctaggatgggctcctctgggaggtcagggctgcaaagtaccggcaagtgggtcatgtggacctcagaccccagagggagccctgctgagagcaacggtgccctggccccccgagtatcaggcagggtcagctatggctgtgccagatgaggtgagctctggagtgtccccttcccagcctctgccctgcctagatgtagcttctttttccccatagaacacagtttggccatagggaggccctccaggtcatctaggtgaggtggaacatgccttctgttaacccgtaatgtgtgaccctgggctggccgtggtgggtgaccctgggctggccgtggtgggtgaccctgggctggccgtggtgggtgaccctgggctggctgtggtatgtgaccctgggctggccgtggtgggtgaccctgagctggctgagtgaccctgggctggccgtggtatgtgacccggggctggccgtggtatgtgaccctgggatggtcatggtgtgtgacccggggctggccatggtgggtgaccccgagctggctgtggtgggtgaccctgggctggccgtggtgggtgaccctgggatggccgtggtgggtgacactgggctggtggtggtgggtgacccttggctggccatggtgggtgaccctgggatggctgtggtgggtgaccctgggatggctgtggtgggtgacactgggctggctgtggtgggtgaccctgggatggtcatggtgggtgaccctgggctggccatggtggttgatgctgggatggtcatggtgggtgaccctgggatggccgtggtgggtgaccctgggatggtcatgatgggtgaccctgggctggctgagtgaccctgggctggccgtggtatgtgacccggggctggccgtggtatgtgaccccgggatggtcatggtgtgtgacccggggctggccgtggtatgtgaccccgggatggtcatggtgtgtgacccggggctggccatggtgggtgaccccgagctggctgtggtgggtgaccctgggctggccgtggtgggtgaccctgggatggccgttgtgggtgacactgggctggtggtggtgggtgacccttggctggccatggtgggtgatgctgggatggtcatggtgggtgaccctgggatggccgcggtgggtgaccctggaatggtcatgatgggtgaccctgggctggctgagtgaccctgggctggccatggtatgtgacccggggctggccgtggtatgtgaccccgggatggtcatggtgtgtgacccggggctggccatggtgggtgaccccgagctggctgtggtgggtgaccctgggctggccgtggtgggtgaccctgggatggccgtggtgggtgacactgggctggtggtggtgggtgacccttggctggccgtggtgggtgacccttggctggctgtggtgggtgacccttggatggctgtggtgggtgaccctgggatggctgtggtgggtgacactgggctggctgtggtgggtgacactgggctggctgtggtgggtgaccctgggctggccgtggtgggtgacgctgggatggtcatggtgggtgaccctgggatggccgcggtgggtgaccctgggctggccgcggtgggtgaccctgggctggacgtggtgggtgaccctgggatggccgcggtgggtgaccctgggctggccgcggtgggtgaccctgggctggccgcggtgggtgaccctgggatggtcgcggtgggtgaccctgggctggccgtggtgggtgaccctgggatggccgtggtgggtgaccctgggctggctgtggtgggtgaccctgggatggtcgcggtgggtgaccctgggctggccgtggtgggtgaccctgggatggccgtggtgggtgaccctgggctggctgtggtgggtgaccctgggatggctgtggtgggtgaccctgggatggcggtggtgggtgacccggggctggccgcggtgggtgaccctgggatggccgcggtgggtgaccctgggctggccgcggtgggtgaccctgggatggccgcggtgggtgaccctgggatggccgtggtgggtgaccctgggctggccgtggtgggtgaccctgggatggtcgtggtgggtgacccggggctggccgtggtatgtgaccctgggctggccgtggtatgtgaccctgggatggtcgtggtgggtgaccctgggctggtgaatgatatgtggcctctgcttccagtttgtcaggctgtcccagagcaacctttgctggaaagaagggaaaactgtcaggggatgaggtcctcagtccaaagttcaagactagcgacggtaaggatggcttcctggatttccctgctcatggctgggtgccagggtaagtgagagctgtgcaccttttgtgctggtgggaagaaggttagggagatgaagcccctcctggaatgagtcacggcagaggcagatcccttcacctaagctgacagcctttcggaccttggctctgaagctcttgacacctgtgtctggggtccctggccctgaggaggtcatgcctgctgtaacctgcggctttggtgaccactgggatcagagtccagtggagcccatgtgctgtgagtttgtggagaggtgtggctcattcccccttaggtgaggaaattcagcattgcctgaacaaacttccatctttaatgtagcatttaatacctcccaaagagatttaagcctttccacctgccagccagctcggaaggcaaactataaacactcatctcacaattttcaagacagatttctccagcgcataatgtggggtatgagccccagagagagatgagctcggaaaaccaggaggggagacctctgctgcacagggggtttcagttctagaaagcaggcttccccacagcactttggcccaggcctgcctgaggcccaaagccacaactgaggtttctctctgggtcagtgttggagaatgatgaggagatcaagcagctgaaccaggagatccgagacctgaacgagtccaactcggagatggaggctgccatggtgcagctgcagtcccaggtaggtggtgccgccccccgctcctgggctctttgcccacccaacccaaacattcgtcttggggacagtgaggcatccgtcggcactcatcaaggttgctgtcagggctgagctgacggacagcgcagtggctggcacacaggcacacttaggacgtgctggccgctcacaatgcggagtccgtgaagtcacactgtgagtgccagtgggccgccggagctggttgtcccgccagggctgtggtctcattagtgttaataacactattaataatactagtcccattaagattagcagcactgtttctcttactctcattagaatgagtagtcctgtcaagaccagcggtcccattaggattaccagtcttgtgagtaccagtggtccatgagcgtggtgcggtagagccaggtctctggagccgggtttccttcccagcacccagcacagccacatgtttgtcacagctgagggacctgacaaacctttcagcctcttcctcagtcaattcctccataaaatggaggtaagaataggattctactccagccagttattgtacaatgaacgcatttctatgaggaaaacattcagcataagcacctgatccagagtaagtgccgtcgatgagagctgctgttgctgagggttaggattacaaattattttaaatgtttgtgtcatatttcctgatttccctaaaatgagcatttgtaatcagaaaaaaaaaagcagtaaagatcttattttgaaaataagagcatgccccacctgtggctgctgagtggagtctgcagccgtgctgggggagacataactgtgcccctaacagctagagggacaaagggacaaggaagtgaccaggtcccacagagaatttgggcagagcccctctgggcagggacagatggggagatggtggcctccaccaaggcagcaaaaaatgagtaacatcctccagccccacgtgtctcattactctgctcttgtctctactggcaaacaggctcatgttgactctgctctggtctctactggcaaacaggctcatgttgactctgctctggtctctactggcaaacaggctcacgttgaccgcttgttactcaagagcctgtataaaaatagcatcaccccacagggatcaggaaggattttcgctgtcatgcacatgtcgatgttgcatccccccaggttcataggcagtgacgacagagaaggagtgatggccctcccggcggagccatccccgtcccctcctggtgtctctgagtgtggagatgcactgttgtgtgggtgtccattttgtgctccctgctcctccccttctcagagtccccagggccttcatcagtgtcagtgtcgttggggtagcacctctgatttctttttatttgccaaaaccaatctttttaaagacagattattaccttttactagcatccctttggaaggactcagaaacccctgtccatctgagggagtttggtgactggtgccctctgcggaagggcaaaggcaaagggaaggcaggtccctatcccccatgcaaccctttcaaagccacatgcttgtcaccaggtggcagaagaagcgtgcttgaccccatccacagcctcccaggaatgagctccccactcctgcctcgtgtgtcacccacactgtctttctgtgagtttagcctctgcccccgtggctccctgcagatgtgcagtcaggctgggggctattcctggacaccaaaggcctcagggccaacacaaccctgggcaggttcaccgccatggtggggaagtgagaagacttgcctgtagttggcctggggaagtcgtgcttgggaggccctgaggaggctctttgtggggatttctggtgaggggaagacccaaaggcagtctgacactccacgggggggtgcagtgatttccatcttacagatagaagcaggaaacatggtgaagctaagaccacagcaggtggagtctgagattgagacagggcgctgtgaagtctgtgctcccaccccatcccctcaggacagaggggctcagaaaaccaggagtggggacttctcctgcacggcgggtttcagttccatctagaaagcatggcacagagggacgtgccacacgagcccccttcctggcttccctggagtcagcccatgtctccagagggcccttgcctttctctcctctgccagcccctcacctgtggcagaaccccctacaggaaggcagggtccctgcctcttcccccaccccagggttctgcattctcccagagggttgtgagaggcagcccagagaggacccccaggaggatgggggccaagggcaggcggcacttcgaatctctctctggcacagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggtaggcagcacgcgggcctgccggcaccacagctaccccccagggtctcttcggaaagcaggagggcagggcatctcccaccccctctgcctctgggtcctgccctaggggccctgtgcccttgtggagattctctccaccccgaatggcccgggctgttggctgtggtgggtttagccaccataatgagtagctgccataaagagtagctaatgaatccaaagcaaaatggtgattccatgagcagagaggctactgctgggatggctgcagagaggaacgcccagtgctgcctctggttggtgtgggcttgtctcaggtcacgtggggacataggtttgatgctcccacatcaggctctgcggtgtggggcccactgcatggacggagcttgctaacctggttctgttctctaggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtg
